(12) United States Patent
Ruike et al.

(10) Patent No.: US 10,000,560 B2
(45) Date of Patent: Jun. 19, 2018

(54) ANTI-MYOSTATIN ANTIBODIES, POLYPEPTIDES CONTAINING VARIANT FC REGIONS, AND METHODS OF USE

(71) Applicant: Chugai Seiyaku Kabushiki Kaisha, Tokyo (JP)

(72) Inventors: Yoshinao Ruike, Singapore (SG); Taichi Kuramochi, Singapore (SG); Hiroyasu Muramatsu, Shizuoka (JP); Atsunori Ueyama, Shizuoka (JP); Tomoyuki Igawa, Shizuoka (JP); Hitoshi Katada, Shizuoka (JP); Yuji Hori, Shizuoka (JP)

(73) Assignee: Chugai Seiyaku Kabushiki Kaisha, Tokyo (JP)

( * ) Notice: Subject to any disclaimer, the term of this patent is extended or adjusted under 35 U.S.C. 154(b) by 0 days. days.

(21) Appl. No.: 14/974,488

(22) Filed: Dec. 18, 2015

(65) Prior Publication Data
US 2016/0200807 A1 Jul. 14, 2016

(30) Foreign Application Priority Data
Dec. 19, 2014 (JP) ................................ 2014-257636

(51) Int. Cl.
*C07K 16/22* (2006.01)
*G01N 33/68* (2006.01)
*A61K 39/00* (2006.01)

(52) U.S. Cl.
CPC ......... *C07K 16/22* (2013.01); *G01N 33/6872* (2013.01); *A61K 2039/505* (2013.01); *C07K 2317/24* (2013.01); *C07K 2317/33* (2013.01); *C07K 2317/34* (2013.01); *C07K 2317/52* (2013.01); *C07K 2317/565* (2013.01); *C07K 2317/76* (2013.01); *C07K 2317/92* (2013.01); *C07K 2317/94* (2013.01); *C12N 2510/02* (2013.01); *G01N 2333/495* (2013.01)

(58) Field of Classification Search
None
See application file for complete search history.

(56) References Cited

U.S. PATENT DOCUMENTS

| | | |
|---|---|---|
| 4,801,687 A | 1/1989 | Ngo |
| 5,322,678 A | 6/1994 | Morgan, Jr. et al. |
| 5,639,641 A | 6/1997 | Pedersen et al. |
| 5,795,965 A | 8/1998 | Tsuchiya et al. |
| 5,827,733 A | 10/1998 | Lee et al. |
| 5,935,935 A | 8/1999 | Connelly et al. |
| 5,990,286 A | 11/1999 | Khawli et al. |
| 6,024,956 A | 2/2000 | Matsushima et al. |
| 6,096,506 A | 8/2000 | Lee et al. |
| 6,165,745 A | 12/2000 | Ward et al. |
| 6,245,894 B1 | 6/2001 | Matsushima et al. |
| 6,329,511 B1 | 12/2001 | Vasquez et al. |
| 6,485,943 B2 | 11/2002 | Stevens et al. |
| 6,677,436 B1 | 1/2004 | Sato et al. |
| 6,737,056 B1 | 5/2004 | Presta |
| 6,821,505 B2 | 11/2004 | Ward |
| 6,884,879 B1 | 4/2005 | Baca et al. |
| 6,913,747 B1 | 7/2005 | Co et al. |
| 7,052,873 B2 | 5/2006 | Tsuchiya |
| 7,247,302 B1 | 7/2007 | Rosok et al. |
| 7,261,893 B2 | 8/2007 | Veldman et al. |
| 7,276,585 B2 | 10/2007 | Lazar et al. |
| 7,320,789 B2 | 1/2008 | Aghajanian et al. |
| 7,358,054 B2 | 4/2008 | Karpusas et al. |
| 7,365,166 B2 | 4/2008 | Baca et al. |
| 7,371,826 B2 | 5/2008 | Presta |
| 7,662,925 B2 | 2/2010 | Lazar et al. |
| 7,670,600 B2 | 3/2010 | Dall'Acqua et al. |
| 7,785,791 B2 | 8/2010 | Presta |
| 7,807,159 B2 | 10/2010 | Chin et al. |
| 7,888,486 B2 | 2/2011 | Walsh et al. |
| 7,955,590 B2 | 6/2011 | Gillies et al. |
| 7,960,512 B2 | 6/2011 | Stavenhagen et al. |

(Continued)

FOREIGN PATENT DOCUMENTS

| | | |
|---|---|---|
| AU | 2011244851 A1 | 11/2011 |
| CA | 2647846 A1 | 10/2007 |

(Continued)

OTHER PUBLICATIONS

Vajdos et al. (J Mol Biol. Jul. 5, 2002;320(2):415-28 ).*
Brown et al. (J Immunol. May 1996;156(9):3285-91).*
Idusogie, E. E., et al., "Engineered Antibodies with Increased Activity to Recruit Complement," *The Journal of Immunology*; 166:2571-2575 (2001).
Kingsley, D. M., "The TGF-β superfamily: new members, new receptors, and new genetic tests of function in different organisms," *Genes & Development*; 8: 133-146 (1994).
Hoodless, P. A., et al., "Mechanism and Function of Signaling by the TGFβ Superfamily," *Current Topics in Microbiology and Immunology*; 228: 235-272 (1998).
Zimmers, T. A., et al., "Induction of Cachexia in Mice by Systemically Administered Myostation," *Science*; 296: 1486-1488 (May 24, 2002).

(Continued)

*Primary Examiner* — Brian Gangle
*Assistant Examiner* — Andrea K McCollum
(74) *Attorney, Agent, or Firm* — Nixon & Vanderhye P.C.

(57) ABSTRACT

The disclosure provides anti-myostatin antibodies and methods of making and using the same. Nucleic acids encoding the anti-myostatin antibodies and host cells comprising the nucleic acids are also provided. The anti-myostatin antibodies have uses that include treating a muscle wasting disease, reducing body fat accumulation, and increasing mass and strength of muscle tissue. The disclosure also provides polypeptides containing a variant Fc region and methods of making and using the same. Nucleic acids encoding the polypeptides and host cells comprising the nucleic acids are also provided. The polypeptides have uses that include suppressing the activation of immune cells; treating an immunological inflammatory disease, autoimmune disease, or viral infection; and increasing muscle mass and strength or reducing body fat accumulation.

43 Claims, 32 Drawing Sheets

(56) References Cited

U.S. PATENT DOCUMENTS

| | | |
|---|---|---|
| 8,062,635 B2 | 11/2011 | Hattori et al. |
| 8,101,720 B2 | 1/2012 | Lazar et al. |
| 8,147,829 B2 | 4/2012 | Hariharan et al. |
| 8,323,962 B2 | 12/2012 | Dall'Acqua et al. |
| 8,497,355 B2 | 7/2013 | Igawa et al. |
| 8,562,991 B2 | 10/2013 | Igawa et al. |
| 8,637,641 B2 | 1/2014 | Dahiyat et al. |
| 8,735,545 B2 | 5/2014 | Lazar et al. |
| 8,753,629 B2 | 6/2014 | Lazar et al. |
| 9,051,373 B2 | 6/2015 | Lazar et al. |
| 9,079,949 B1 | 7/2015 | Andrien, Jr. et al. |
| 9,096,651 B2 | 8/2015 | Igawa et al. |
| 9,605,061 B2 | 3/2017 | Lazar et al. |
| 9,670,269 B2 | 6/2017 | Igawa et al. |
| 2002/0137897 A1 | 9/2002 | Stevens et al. |
| 2002/0142374 A1 | 10/2002 | Gallo et al. |
| 2002/0164339 A1 | 11/2002 | Do Couto et al. |
| 2003/0059937 A1 | 3/2003 | Ruben et al. |
| 2003/0103970 A1 | 6/2003 | Tsuchiya |
| 2003/0224397 A1 | 12/2003 | Lowman et al. |
| 2004/0081651 A1 | 4/2004 | Karpusas et al. |
| 2004/0110226 A1 | 6/2004 | Lazar et al. |
| 2004/0132101 A1 | 7/2004 | Lazar et al. |
| 2004/0133357 A1 | 7/2004 | Zhong et al. |
| 2004/0236080 A1 | 11/2004 | Aburatani et al. |
| 2005/0064514 A1 | 3/2005 | Stavenhagen et al. |
| 2005/0095243 A1 | 5/2005 | Chan et al. |
| 2005/0244403 A1 | 11/2005 | Lazar et al. |
| 2005/0260213 A1 | 11/2005 | Koenig et al. |
| 2005/0260711 A1 | 11/2005 | Datta et al. |
| 2005/0261229 A1 | 11/2005 | Gillies et al. |
| 2006/0014156 A1 | 1/2006 | Rabbani et al. |
| 2006/0019342 A1 | 1/2006 | Dall'Acqua et al. |
| 2006/0063228 A1 | 3/2006 | Kasaian et al. |
| 2006/0141456 A1 | 6/2006 | Edwards et al. |
| 2006/0153860 A1 | 7/2006 | Cho et al. |
| 2006/0194291 A1 | 8/2006 | Presta |
| 2006/0198840 A1 | 9/2006 | Dall'Acqua et al. |
| 2007/0003546 A1 | 1/2007 | Lazar et al. |
| 2007/0009523 A1 | 1/2007 | Presta |
| 2007/0036785 A1 | 2/2007 | Kishimoto et al. |
| 2007/0037734 A1 | 2/2007 | Rossi et al. |
| 2007/0041978 A1 | 2/2007 | Hattori et al. |
| 2007/0059312 A1 | 3/2007 | Baca et al. |
| 2007/0148164 A1 | 6/2007 | Farrington et al. |
| 2007/0160598 A1 | 7/2007 | Dennis et al. |
| 2007/0190056 A1 | 8/2007 | Kambadur et al. |
| 2007/0231329 A1 | 10/2007 | Lazar et al. |
| 2008/0044417 A1 | 2/2008 | Johnson et al. |
| 2008/0138349 A1 | 6/2008 | Stavenhagen et al. |
| 2008/0166756 A1 | 7/2008 | Tsuchiya et al. |
| 2008/0199471 A1 | 8/2008 | Bernett et al. |
| 2008/0274506 A1 | 11/2008 | Presta |
| 2009/0041770 A1 | 2/2009 | Chamberlain et al. |
| 2009/0053240 A1 | 2/2009 | Lazar et al. |
| 2009/0076251 A1 | 3/2009 | Koenig et al. |
| 2009/0136485 A1 | 5/2009 | Chu et al. |
| 2009/0263392 A1 | 10/2009 | Igawa et al. |
| 2009/0324589 A1 | 12/2009 | Igawa et al. |
| 2010/0098710 A1 | 4/2010 | Hariharan et al. |
| 2010/0098730 A1 | 4/2010 | Lowman et al. |
| 2010/0099147 A1 | 4/2010 | Hariharan et al. |
| 2010/0184959 A1 | 7/2010 | Guler-Gane et al. |
| 2010/0216187 A1 | 8/2010 | Lasters et al. |
| 2010/0239577 A1 | 9/2010 | Igawa et al. |
| 2010/0249482 A1 | 9/2010 | Chung et al. |
| 2010/0292443 A1 | 11/2010 | Sabbadini et al. |
| 2010/0298542 A1 | 11/2010 | Igawa et al. |
| 2011/0021755 A1 | 1/2011 | Lazar et al. |
| 2011/0027276 A1 | 2/2011 | Bernett et al. |
| 2011/0044986 A1 | 2/2011 | Biere-Citron et al. |
| 2011/0098450 A1 | 4/2011 | Igawa et al. |
| 2011/0111406 A1 | 5/2011 | Igawa et al. |
| 2011/0150888 A1 | 6/2011 | Foltz et al. |
| 2011/0223658 A1 | 9/2011 | Beliard et al. |
| 2011/0229489 A1 | 9/2011 | Pons et al. |
| 2011/0245473 A1 | 10/2011 | Igawa et al. |
| 2011/0311454 A1 | 12/2011 | Dall'Acqua et al. |
| 2012/0028304 A1 | 2/2012 | Dahiyat et al. |
| 2013/0011866 A1 | 1/2013 | Igawa et al. |
| 2013/0303396 A1 | 11/2013 | Igawa et al. |
| 2013/0336963 A1 | 12/2013 | Igawa et al. |
| 2014/0093496 A1 | 4/2014 | Mimoto et al. |
| 2014/0105889 A1 | 4/2014 | Igawa et al. |
| 2014/0199294 A1 | 7/2014 | Mimoto et al. |
| 2014/0234340 A1 | 8/2014 | Igawa et al. |
| 2014/0249297 A1 | 9/2014 | Lazar et al. |
| 2014/0294833 A1 | 10/2014 | Desjarlais et al. |
| 2014/0335089 A1 | 11/2014 | Igawa et al. |
| 2014/0363426 A1 | 12/2014 | Moore et al. |
| 2014/0363428 A1 | 12/2014 | Igawa et al. |
| 2015/0050269 A1 | 2/2015 | Igawa et al. |
| 2015/0166636 A1 | 6/2015 | Igawa et al. |
| 2015/0203577 A1 | 7/2015 | Igawa et al. |
| 2015/0210763 A1 | 7/2015 | Kuramochi et al. |
| 2015/0284465 A1 | 10/2015 | Igawa et al. |
| 2015/0299296 A1 | 10/2015 | Katada et al. |
| 2015/0299313 A1 | 10/2015 | Igawa et al. |
| 2015/0315278 A1 | 11/2015 | Igawa et al. |
| 2015/0344570 A1 | 12/2015 | Igawa et al. |
| 2015/0353630 A1 | 12/2015 | Igawa et al. |
| 2016/0039912 A1 | 2/2016 | Mimoto et al. |
| 2016/0046693 A1 | 2/2016 | Igawa et al. |
| 2016/0200807 A1 | 7/2016 | Ruike et al. |
| 2016/0229908 A1 | 8/2016 | Igawa et al. |

FOREIGN PATENT DOCUMENTS

| | | |
|---|---|---|
| CA | 2700986 A1 | 4/2009 |
| CN | 1763097 A | 4/2006 |
| CN | 101014619 A | 8/2007 |
| CN | 101277976 A | 10/2008 |
| CN | 101282992 A | 10/2008 |
| CN | 102056946 A | 5/2011 |
| CN | 101001873 B | 3/2013 |
| CN | 103492565 A | 1/2014 |
| CN | 102633880 B | 2/2015 |
| EP | 0182495 A1 | 5/1986 |
| EP | 0 770 628 A1 | 5/1997 |
| EP | 0783893 A1 | 7/1997 |
| EP | 1069185 A1 | 1/2001 |
| EP | 1773391 A2 | 4/2007 |
| EP | 1601697 B1 | 5/2007 |
| EP | 1870459 A1 | 12/2007 |
| EP | 0770628 B1 | 9/2008 |
| EP | 2006381 A1 | 12/2008 |
| EP | 2009101 A1 | 12/2008 |
| EP | 2 202 245 A1 | 6/2010 |
| EP | 2196541 A1 | 6/2010 |
| EP | 2275443 A1 | 1/2011 |
| EP | 1069185 B1 | 6/2011 |
| EP | 2 368 911 A1 | 9/2011 |
| EP | 2 431 393 A1 | 3/2012 |
| EP | 2 679 681 A1 | 1/2014 |
| EP | 2698431 A1 | 2/2014 |
| EP | 2 762 166 A1 | 8/2014 |
| EP | 2 762 493 A1 | 8/2014 |
| EP | 2 762 564 A1 | 8/2014 |
| EP | 2 818 183 A1 | 12/2014 |
| EP | 2 853 898 A1 | 4/2015 |
| EP | 2889377 A1 | 7/2015 |
| EP | 2940043 A1 | 11/2015 |
| EP | 2853898 B1 | 1/2017 |
| JP | S61117457 A | 6/1986 |
| JP | S6352890 A | 3/1988 |
| JP | H0228200 A | 1/1990 |
| JP | H02163085 A | 6/1990 |
| JP | H0767688 A | 3/1995 |
| JP | 2003512019 A | 4/2003 |
| JP | 2004511426 A | 4/2004 |
| JP | 2005535341 A | 11/2005 |
| JP | 2006512407 A | 4/2006 |
| JP | 2006519583 A | 8/2006 |
| JP | 2007532139 A | 11/2007 |

(56) References Cited

FOREIGN PATENT DOCUMENTS

| | | |
|---|---|---|
| JP | 2008511292 A | 4/2008 |
| JP | 2010505436 A | 2/2010 |
| JP | 2010514460 A | 5/2010 |
| JP | 2011504096 A | 2/2011 |
| JP | 2012512641 A | 6/2012 |
| JP | 5055603 B2 | 10/2012 |
| JP | 5144499 B2 | 2/2013 |
| JP | 2013518131 A | 5/2013 |
| JP | 2013165716 A | 8/2013 |
| JP | 2013531486 A | 8/2013 |
| JP | 5334319 B2 | 11/2013 |
| JP | 5357778 B2 | 12/2013 |
| RU | 2236222 C2 | 9/2004 |
| RU | 2266298 C2 | 12/2005 |
| RU | 2337107 C2 | 10/2008 |
| RU | 2430111 C1 | 9/2011 |
| RU | 2010116152 A | 11/2011 |
| RU | 2505603 C2 | 1/2014 |
| SG | 192945 A1 | 9/2013 |
| TW | 201202419 A | 1/2012 |
| WO | WO 91/13631 | 9/1991 |
| WO | WO-9219759 A1 | 11/1992 |
| WO | WO 94/21681 | 9/1994 |
| WO | WO-9514710 A1 | 6/1995 |
| WO | WO 96/02576 | 2/1996 |
| WO | WO-9611020 A1 | 4/1996 |
| WO | WO-9612503 A1 | 5/1996 |
| WO | WO-9803546 A1 | 1/1998 |
| WO | WO-9805787 A1 | 2/1998 |
| WO | WO-9918212 A1 | 4/1999 |
| WO | WO-9951642 A1 | 10/1999 |
| WO | WO-9951743 A1 | 10/1999 |
| WO | WO-9958572 A1 | 11/1999 |
| WO | WO-0014220 A | 3/2000 |
| WO | WO-0015214 A1 | 3/2000 |
| WO | WO 00/42072 | 7/2000 |
| WO | WO-0130854 A2 | 5/2001 |
| WO | WO-0182899 A2 | 11/2001 |
| WO | WO 02/09641 A2 | 2/2002 |
| WO | WO-02060919 A2 | 8/2002 |
| WO | WO-03000883 A1 | 1/2003 |
| WO | WO-03020949 A2 | 3/2003 |
| WO | WO-03027248 A2 | 4/2003 |
| WO | WO-03070760 A2 | 8/2003 |
| WO | WO-03074679 A2 | 9/2003 |
| WO | WO-03105757 A2 | 12/2003 |
| WO | WO-03107009 A2 | 12/2003 |
| WO | WO-2004016740 A2 | 2/2004 |
| WO | WO 2004/024890 A2 | 3/2004 |
| WO | WO 2004/024890 A2 * | 3/2004 ........... C07K 14/475 |
| WO | WO 2004/029207 A2 | 4/2004 |
| WO | WO 2004/037861 A2 | 5/2004 |
| WO | WO-2004039826 A1 | 5/2004 |
| WO | WO-2004058797 A2 | 7/2004 |
| WO | WO-2004068931 A2 | 8/2004 |
| WO | WO 2004/099249 A2 | 11/2004 |
| WO | WO-2004096273 A1 | 11/2004 |
| WO | WO 2004/108157 A2 | 12/2004 |
| WO | WO-2005035756 A1 | 4/2005 |
| WO | WO-2005047327 A2 | 5/2005 |
| WO | WO-2005056759 A2 | 6/2005 |
| WO | WO-2005059106 A2 | 6/2005 |
| WO | WO-2005067620 A2 | 7/2005 |
| WO | WO-2005077981 A2 | 8/2005 |
| WO | WO 2005/094446 A2 | 10/2005 |
| WO | WO-2005092925 A2 | 10/2005 |
| WO | WO-2005112564 A2 | 12/2005 |
| WO | WO-2005115452 A2 | 12/2005 |
| WO | WO-2005123126 A2 | 12/2005 |
| WO | WO 2006/004663 A2 | 1/2006 |
| WO | WO 2006/019447 A1 | 2/2006 |
| WO | WO 2006/020114 A2 | 2/2006 |
| WO | WO-2006030200 A1 | 3/2006 |
| WO | WO-2006030220 A1 | 3/2006 |
| WO | WO-2006031370 A2 | 3/2006 |
| WO | WO 2006/047350 A2 | 5/2006 |
| WO | WO-2006050166 A2 | 5/2006 |
| WO | WO-2006050491 A2 | 5/2006 |
| WO | WO-2006053301 A2 | 5/2006 |
| WO | WO-2006066598 A2 | 6/2006 |
| WO | WO-2006067913 A1 | 6/2006 |
| WO | WO 2006/076594 A2 | 7/2006 |
| WO | WO-2006071877 A2 | 7/2006 |
| WO | WO 2006/083182 A1 | 8/2006 |
| WO | WO 2006/083183 A1 | 8/2006 |
| WO | WO-2006085967 A2 | 8/2006 |
| WO | WO 2006/102095 A2 | 9/2006 |
| WO | WO 2006/113643 A2 | 10/2006 |
| WO | WO-2006105338 A2 | 10/2006 |
| WO | WO-2006106905 A1 | 10/2006 |
| WO | WO-2006109592 A1 | 10/2006 |
| WO | WO-2006116269 A2 | 11/2006 |
| WO | WO-2006121852 A2 | 11/2006 |
| WO | WO 2007/001422 A2 | 1/2007 |
| WO | WO-2007008943 A2 | 1/2007 |
| WO | WO-2007024249 A2 | 3/2007 |
| WO | WO-2007024535 A2 | 3/2007 |
| WO | WO 2007/047112 A2 | 4/2007 |
| WO | WO-2007041635 A2 | 4/2007 |
| WO | WO-2007044411 A2 | 4/2007 |
| WO | WO-2007044616 A2 | 4/2007 |
| WO | WO-2007060411 A1 | 5/2007 |
| WO | WO-2007076524 A2 | 7/2007 |
| WO | WO-2007092772 A2 | 8/2007 |
| WO | WO 2007/114319 A2 | 10/2007 |
| WO | WO-2007114325 A1 | 10/2007 |
| WO | WO-2007142325 A1 | 12/2007 |
| WO | WO-2008002933 A2 | 1/2008 |
| WO | WO-2008022152 A2 | 2/2008 |
| WO | WO-2008030706 A2 | 3/2008 |
| WO | WO-2008036688 A2 | 3/2008 |
| WO | WO-2008043822 A2 | 4/2008 |
| WO | WO-2008060785 A2 | 5/2008 |
| WO | WO-2008091798 A2 | 7/2008 |
| WO | WO-2008091954 A2 | 7/2008 |
| WO | WO-2008092117 A2 | 7/2008 |
| WO | WO-2008098115 A2 | 8/2008 |
| WO | WO-2008121160 A2 | 10/2008 |
| WO | WO-2008130969 A2 | 10/2008 |
| WO | WO-2008150494 A1 | 12/2008 |
| WO | WO-2009000098 A2 | 12/2008 |
| WO | WO-2009000099 A2 | 12/2008 |
| WO | WO-2009006338 A1 | 1/2009 |
| WO | WO-2009026117 A2 | 2/2009 |
| WO | WO-2009032145 A1 | 3/2009 |
| WO | WO-2009032782 A2 | 3/2009 |
| WO | WO 2009/041643 A1 | 4/2009 |
| WO | WO-2009041062 A1 | 4/2009 |
| WO | WO 2009/062083 A2 | 5/2009 |
| WO | WO-2009058346 A1 | 5/2009 |
| WO | WO-2009058492 A2 | 5/2009 |
| WO | WO-2009086320 A1 | 7/2009 |
| WO | WO 2009/125825 A1 | 10/2009 |
| WO | WO-2009139822 A1 | 11/2009 |
| WO | WO-2009155513 A2 | 12/2009 |
| WO | WO-2010033736 A1 | 3/2010 |
| WO | WO-2010045193 A1 | 4/2010 |
| WO | WO 2010/070094 A1 | 6/2010 |
| WO | WO-2010107109 A1 | 9/2010 |
| WO | WO 2010/151338 A2 | 12/2010 |
| WO | WO-2011021009 A1 | 2/2011 |
| WO | WO-2011094593 A2 | 8/2011 |
| WO | WO-2011100271 A2 | 8/2011 |
| WO | WO-2011111007 A2 | 9/2011 |
| WO | WO 2011/122011 A2 | 10/2011 |
| WO | WO 2011/151432 A1 | 12/2011 |
| WO | WO-2011150008 A2 | 12/2011 |
| WO | WO 2012/016227 A2 | 2/2012 |
| WO | WO-2012024242 A1 | 2/2012 |
| WO | WO 2012/073992 A1 | 6/2012 |
| WO | WO 2012/093704 A1 | 7/2012 |
| WO | WO 2012/115241 A1 | 8/2012 |
| WO | WO 2012/132067 A1 | 10/2012 |
| WO | WO 2012/133782 A1 | 10/2012 |

(56) References Cited

FOREIGN PATENT DOCUMENTS

| | | |
|---|---|---|
| WO | WO-2013012733 A1 | 1/2013 |
| WO | WO 2013/046704 A | 4/2013 |
| WO | WO 2013/046722 A1 | 4/2013 |
| WO | WO 2013/047752 A1 | 4/2013 |
| WO | WO-2013047729 A1 | 4/2013 |
| WO | WO-2013047748 A1 | 4/2013 |
| WO | WO 2013/081143 A1 | 6/2013 |
| WO | WO 2013/125667 A1 | 8/2013 |
| WO | WO-2013138680 A1 | 9/2013 |
| WO | WO-2013152001 A2 | 10/2013 |
| WO | WO-2013166099 A1 | 11/2013 |
| WO | WO-2013186719 A1 | 12/2013 |
| WO | WO-2014006217 A1 | 1/2014 |
| WO | WO 2014/030728 A1 | 2/2014 |
| WO | WO 2014/030750 A1 | 2/2014 |
| WO | WO-2014028354 A1 | 2/2014 |
| WO | WO 2014/074532 A2 | 5/2014 |
| WO | WO-2014114651 A1 | 7/2014 |
| WO | WO 2014/144903 A1 | 9/2014 |
| WO | WO 2014/145159 A2 | 9/2014 |
| WO | WO-2014144080 A2 | 9/2014 |
| WO | WO-2014144575 A1 | 9/2014 |
| WO | WO-2014145806 A2 | 9/2014 |
| WO | WO 2014/163101 A1 | 10/2014 |
| WO | WO 2014/182676 A2 | 11/2014 |
| WO | WO-2014184384 A1 | 11/2014 |
| WO | WO-2014190441 A1 | 12/2014 |
| WO | WO-2015022658 A2 | 2/2015 |
| WO | WO-2015111008 A2 | 7/2015 |
| WO | WO 2015/162590 A1 | 10/2015 |
| WO | WO-2016073853 A1 | 5/2016 |
| WO | WO 2016073879 A2 | 5/2016 |
| WO | WO-2016073906 A2 | 5/2016 |
| WO | WO 2016/098357 A1 | 6/2016 |
| WO | WO-2016092439 A1 | 6/2016 |
| WO | WO-2016125495 A1 | 8/2016 |
| WO | WO-2016168613 A1 | 10/2016 |
| WO | WO-2017046994 A1 | 3/2017 |
| WO | WO-2017049011 A1 | 3/2017 |
| WO | WO-2017104783 A1 | 6/2017 |
| WO | WO-2017120523 A1 | 7/2017 |

OTHER PUBLICATIONS

McPherron, A. C., et al., "Regulation of skeletal muscle mass in mice by a new TGF-β superfamily member," Nature; 387: 83-90 (May 1997).
McPherron, A. C., et al., "Double muscling in cattle due to mutations in the myostatin gene," Proc. Natl. Acad. Sci. USA; 94: 12457-12461 (Nov. 1997).
Szláma, G., et al., "Latent myostatin has significant activity and this activity is controlled more efficiently by WFIKKN1 than by WFIKKN2," The FEBS Journal; 280: 3822-3839 (2013).
Lee, S.-J., "Genetic Analysis of the Role of Proteolysis in the Activation of Latent Myostatin" PLoS ONE; 3(2): e1628 (Feb. 2008).
Lee, S.-J., et al., "Regulation of myostatin activity and muscle growth," PNAS; 98(16): 9306-9311 (Jul. 31, 2001).
McCroskery, S., et al., "Improved muscle healing through enhanced regeneration and reduced fibrosis in myostatin-null mice," Journal of Cell Science; 118: 3531-3541 (2005).
Whittemore, L.-A., et al., "Inhibition of myostatin in adult mice increases skeletal muscle mass and strength," Biochemical and Biophysical Research Communications; 300: 965-971 (2003).
Bogdanovich, S., et al., "Functional improvement of dystrophic muscle by myostatin blockade," Nature; 420: 418-421 (Nov. 28, 2002).
Wagner, K. R., et al., "Loss of Myostatin Attenuates Severity of Muscular Dystrophy in mdx Mice," Ann. Neurol.; 52: 832-836 (2002).
Reichert, J. M., et al., "Monoclonal antibody successes in the clinic," Nature Biotechnology; 23(9): 1073-1078 (Sep. 2005).

Pavlou, A. K., et al., "The therapeutic antibodies market to 2008," European Journal of Pharmaceutics and Biopharmaceutics; 59: 389-396 (2005).
Clark, M. R., "IgG Effector Mechanisms," Chem. Immunol.; 65: 88-110 (1997).
Jefferis, R., et al., "Interaction sites on human IgG-Fc for FcγR: current models," Immunology Letters; 82: 57-65 (2002).
Smith, K. G. C., et al., "FcγRIIB in autoimmunity and infection: evolutionary and therapeutic implications," Nature; 10: 328-343 (May 2010).
Radeav, S., et al., "Recognition of IgG by Fcγ Receptor," The Journal of Biological Chemistry; 276(19): 16478-16483 (May 11, 2001).
Greenwood, J., et al., "Structural motifs involved in human IgG antibody functions," Eur. J. Immunol.; 23: 1098-1104 (1993).
Morgan, A., et al., "The N-terminal end of the $C_H 2$ domain of chimeric human IgG1 anti-HLA-DR is necessary for C1q, FcγR1 and FcγRIII binding," Immunology; 86: 319-324 (1995).
Nimmerjahn, F., et al., "Fcγ receptors as regulators of immune responses," Nature; 8: 34-47 (Jan. 2008).
Amigorena, S., et al., "FcγRII expression in resting and activated B lymphocytes," Eur. J. Immunol.; 19: 1379-1385 (1989).
Sinclair, N., "Regulation of the Immune Response," J. Exp. Med.; 129(6): 1183-1201 (Jun. 1, 1969).
Heyman, B., "Feedback regulation by IgG antibodies," Immunology Letters; 88: 157-161 (2003).
Amigorena, S., et al., "Cytoplasmic Domain Heterogeneity and Functions of IgG Fc Receptors in B Lymphocytes," Science; 256: 1808-1812 (Jun. 26, 1992).
Muta, T., et al., A 13-amino-acid motif in the cytoplasmic domain of FcγRIIB modulates B-cell receptor signalling; Nature; 368: 70-73 (Mar. 3, 1994).
Ravetch, J. V., et al., "Immune Inhibitory Receptors," Science; 290: 84-89 (Oct. 6, 2000).
Fournier, E. M., et al., "Activation of Human Peripheral IgM B Cells Is Transiently Inhibited by BCR-Independent Aggregation of FcγRIIB," The Journal of Immunology; 181: 5350-5359 (2008).
Wernersson, S., et al., "IgG-Mediated Enhancement of Antibody Responses Is Low in Fc Receptor γ Chain-Deficient Mice and Increased in FcγRII-Deficient Mice," The Journal of Immunolgy; 163: 618-622 (1999).
Yuasa, T., et al., "Deletion of Fcγ Receptor IIB Renders $H-2^b$ Mice Susceptible to Collagen-induced Arthritis," J. Exp. Med.; 189(1): 187-194 (Jan. 4, 1999).
Nakamura, A., et al., "Fcγ Receptor IIB-deficient Mice Develop Goodpasture's Syndrome upon Immunization with Type IV Collagen: A Novel Murine Model for Autoimmune Glomerular Basement Membrane Disease," J. Exp. Med.; 191(5): 899-905 (Mar. 6, 2000).
Blank, M. C., et al., "Decreased transcription of the human FCGR2B gene mediated by the -343 G/C promoter polymorphism and association with systemic lupus erythematosus," Hum. Genet.; 117: 220-227 (2005).
Olferiev, M., et al., "The Role of Activating Protein 1 in the Transcriptional Regulation of the Human FCGR2B Promoter Mediated by the -343 G→C Polymorphism Associated with Systemic Lupus Erythematosus," The Journal of Biological Chemistry; 282(3): 1738-1746 (Jan. 19, 2007).
Chen, J.-Y., et al., "Association of a Transmembrane Polymorphism of Fcγ Receptor IIb (FCGR2B) With Systemic Lupus Erythematosus in Taiwanese Patients," Arthritis & Rheumatism; 54(12): 3908-3917 (Dec. 2006).
Floto, R. A., et al., "Loss of function of a lupus-associated FcγRIIb polymorphism through exclusion from lipid rafts," Nature Medicine; 11(10): 1056-1058 (Oct. 2005).
Li, D. H., et al., "CD72 Down-Modulates BCR-Induced Signal Transduction and Diminishes Survival in Primary Mature B Lymphocytes," The Journal of Immunology; 176: 5321-5328 (2006).
Mackay, M., et al., "Selective dysregulation of the FcγIIB receptor on memory B cells in SLE," J. Exp. Med.; 203(9): 2157-2164 (Oct. 2006).
Su, K.., et al., "Expression Profile of FcγRIIb on Leukocytes and Its Dysregulation in Systemic Lupus Erythematosus," The Journal of Immunology; 178: 3272-3280 (2007).

(56) References Cited

OTHER PUBLICATIONS

Bruhns, P., et al., "Specificity and affinity of human Fcγ receptors and their polymorphic variants for human IgG subclasses," *Blood*; 113(16): 3716-3725 (Apr. 16, 2009).
Chu, S. Y., et al., "Inhibition of B cell receptor-mediated activation of primary human B cells by coengagement of CD19 and FcγRIIb with Fc-engineered antibodies," *Molecular Immunology*; 45: 3926-3933 (2008).
Chu, S. Y., et al., "Reduction of total IgE by targeted coengagement of IgE B-cell receptor and FcγRIIb with Fc-engineered antibody," *J. Allergy Clin. Immunol.*: 129(4): 1102-1115 (Apr. 2012).
Veri, M.-C., et al., "Therapeutic Control of B Cell Activation via Recruitment of Fcγ Receptor IIb (CD32B) Inhibitory Function With a Novel Bispecific Antibody Scaffold," *Arthritis & Rheumatism*; 62(7): 1933-1943 (Jul. 2010).
Cemerski, S., et al., "Suppression of mast cell degranulation through a dual-targeting tandem IgE-IgG Fc domain biologic engineered to bind with high affinity to FcγRIIb," *Immunology Letters*; 143: 34-43 (2012).
Wenink, M. H., et al., "The Inhibitory FcγIIb Receptor Dampens TLR4-Mediated Immune Responses and Is Selectively Up-regulated on Dendritic Cells from Rheumatoid Arthritis Patients with Quiescent Disease," *The Journal of Immunology*; 183: 4509-4520 (2009).
Zhang, Y., et al., "Immune Complex/Ig Negatively Regulate TLR4-Triggered Inflammatory Response in Macrophages through FcγRIIb-Dependent $PGE_2$ Production," *The Journal of Immunology*; 182: 554-562 (2009).
Li, F., et al., "Inhibitory Fcγ Receptor Engagement Drives Adjuvant and Anti-Tumor Activities of Agonistic CD40 Antibodies," *Science*; 333: 1030-1034 (Aug. 19, 2011).
Wilson, N. S., et al., "An Fcγ Receptor-Dependent Mechanism Drives Antibody-Mediated Target-Receptor Signaling in Cancer Cells," *Cancer Cell*; 19: 101-113 (Jan. 18, 2011).
Kohrt, H. E., et al., "Stimulation of natural killer cells with a CD137-specific antibody enhances trastuzumab efficacy in xenotransplant models of breast cancer," *The Journal of Clinical Investigation*; 122(3): 1066-1075 (Mar. 2012).
Xu, Y., et al., "FcγRs Modulate Cytotoxicity of Anti-Fas Antibodies: Implications for Agonistic Antibody-Based Therapeutics," *The Journal of Immunology*; 171: 562-568 (2003).
Zhang, M., et al., "Effective therapy for a murine model of human anaplastic large-cell lymphoma with the anti-CD30 monoclonal antibody, HeFi-1, does not require activating Fc receptors," *Blood*; 108(2): 705-710 (Jul. 15, 2006).
Chuntharapai A., et al, "Isotype-Dependent Inhibition of Tumor Growth In Vivo by Monoclonal Antibodies to Death Receptor 4," *The Journal of Immunology*; 166: 4891-4898 (2001).
Li, F., et al., "Apoptotic and antihumor activity of death receptor antibodies require inhibitory Fcγ receptor engagement," *PNAS*; 109(27): 10966-10971 (Jul. 3, 2012).
Malbec, O., et al., "Antibodies against growth factor receptors can inhibit the proliferation of transformed cells via a cis-interaction with inhibitory FcR," *Immunology Letters*; 143: 28-33 (2012).
Scappaticci, F. A., et al., "Arterial Tromboembolic Events in Patients with Metastatic Carcinoma Treated with Chemotherapy and Bevacizumab," *JNCI*; 99(16): 1232-1239 (Aug. 15, 2007).
Boumpas, D. T., et al., "A Short Course of BG9588 (Anti-CD40 Ligand Antibody) Improves Serologic Activity and Decreases Hematuria in Patients With Proliferative Lupus Glomerulonephritis," *Arthritis & Rheumatism*; 48(3): 719-727 (Mar. 2003).
Meyer, T., et al., "Bevacizumab immune complexes activate platelets and induce thrombosis in FCGR2A transgenic mice," *J. Thromb. Haemost.*; 7: 171-181 (2009).
Robles-Carrillo, L., et al., "Anti-CD40L Immune Complexes Potently Activate Platelets In Vitro and Cause Thrombosis in FCGR2A Transgenic Mice," *The Journal of Immunology*; 185: 1577-1583 (2010).
Duffau, P., et al., "Platelet CD154 Potentiates Interferon-α Secretion by Plasmacytoid Dendritic Cells in Systemic Lupus Erythematosus," *Science Translational Medicine*; 2(47): 47ra63 (Sep. 1, 2010).
Richards, J. O., et al., "Optimization of antibody binding to FcγRIIa enhances macrophage phagocytosis of tumor cells," *Mol. Cancer Ther.*; 7(8): 2517-2527 (Aug. 2008).
Desai, D. D., et al., "Fcγ Receptor IIb on Dendritic Cells Enforces Peripheral Tolerance by Inhibiting Effector T Cell Responses," *The Journal of Immunology*; 178: 6217-6226 (2007).
Salmon, J. E., et al., "FcγRIIA Alleles Are Heritable Risk Factors for Lupus Nephritis in African Americans," *The Journal of Clinical Investigation*; 97(5): 1348-1354 (Mar. 1996).
Manger, K., et al., "Fcγ Receptor IIa Polymorphism in Caucasian Patients With Systemic Lupus Erythematosus," *Arthritis & Rheumatism*; 41(7): 1181-1189 (Jul. 1998).
Boruchov, A. M., et al., "Activating and inhibitory IgG Fc receptors on human DCs mediate opposing functions," *The Journal of Clinical Investigation*; 115(10): 2914-2923 (Oct. 2005).
Dhodapkar, K. M., et al., "Selective blockade of inhibitory Fcγ receptor enables human dendritic cell maturation with IL-12p70 production and immunity to antibody-coated tumor cells," *PNAS*; 102(8): 2910-2915 (Feb. 22, 2005).
Armour, K. L., et al., "Differential binding to human FcγRIIa and FcγRIIb receptors by human IgG wildtype and mutant antibodies," *Molecular Immunology*; 40: 585-593 (2003).
Warmerdam, P. A. M., et al., "Molecular Basis for a Polymorphism of Human Fcγ Receptor II (CD32)," *J. Exp. Med.*; 172: 19-25 (Jul. 1990).
Mimoto, F., et al., "Engineered antibody Fc variant with selectively enhanced Fc γRIIb binding over both Fc γRIIaR$^{131}$ and Fc γRIIa$^{H131}$," *Protein Engineering, Design & Selection*; 26(10): 589-598 (2013).
Moore, G. L., et al., "Engineered Fc variant antibodies with enhanced ability to recruit complements and mediate effector functions," *mAbs*; 2(2): 181-189 (Mar./Apr. 2010).
Office Action dated Jul. 27, 2016 for commonly-owned U.S. Appl. No. 12/295,039.
Onda, M., et al., "Lowering the Isoelectric Point of the Fv Portion of Recombinant Immunotoxins Leads to Decreased Nonspecific Animal Toxicity without Affecting Antitumor Activity," Cancer Research; 61: 5070-5077 (Jul. 1, 2001).
Notice of Allowance dated Aug. 9, 2016 for commonly-owned U.S. Appl. No. 13/889,512.
Schröter, C., et al., "A generic approach to engineer antibody pH-switches using combinatorial histidine scanning libraries and yeast display," mAbs; 7(1): 138-151 (Jan./Feb. 2015).
Wu, S.-J., et al., "Structure-based engineering of a monoclonal antibody for improved solubility," *Protein Engineering, Design & Selection*; 23(8): 643-651 (2010).
Kim, S. J., et al., "Antibody Engineering for the Development of Therapeutic Antibodies," *Mol. Cells*; 20(1): 17-29 (2005).
Hinton, P. R., et al., "An Engineered Human IgG1 Antibody with Longer Serum Half-Life," *The Journal of Immunology*; 176: 346-356 (2006).
Ghetie, V., et al., "Increasing the serum persistence of an IgG fragment by random mutagenesis," *Nature Biotechnology*; 15: 637-640 (Jul. 1997).
Rajpal, A., et al., "A general method for greatly improving the affinity of antibodies by using combinatorial libraries," *PNAS*; 102(24): 8466-8471 (Jun. 14, 2005).
Wu, H., et al., "Development of Motavizumab, an Ultra-potent Antibody for the Prevention of Respiratory Syncytial Virus Infection in the Upper and Lower Respiratory Tract," *J. Mol. Biol.*; 368: 652-665 (2007).
Igawa, T., et al., "Antibody recycling by engineered pH-dependent antigen binding improves the duration of antigen neutralization," *Nature Biotechnology*; 28(11): 1203-1207 (Nov. 2010).
Dall'Acqua, W. F., et al., "Properties of Human IgG1s Engineered for Enhanced Binding to the Neonatal Fc Receptor (FcRn)," *The Journal of Biological Chemistry*; 281(33): 23514-23524 (Aug. 18, 2006).
Zalevsky, J., et al., "Enhanced antibody half-life improves in vivo activity," *Nature Biotechnology*; 28(2): 157-159 (Feb. 2010).

(56) References Cited

OTHER PUBLICATIONS

Zheng, Y., et al., "Translational Pharmacokinetics and Pharmacodynamics of an FcRn-Variant Anti-CD4 Monoclonal Antibody From Preclinical Model to Phase I Study," *Clinical Pharmacology & Therapeutics*; 89(2): 283-290 (Feb. 2011).

Lazar, G. A., et al., "Engineered antibody Fc variants with enhanced effector function," *PNAS*; 103(11): 4005-4010 (Mar. 14, 2006).

Shinkawa, T., et al., "The Absence of Fucose but Not the Presence of Galactose or Bisecting N-Acetylglucosamine of Human IgG1 Complex-type Oligosaccharides Shows the Critical Role of Enhancing Antibody-dependent Cellular Cytotoxicity," *The Journal of Biological Chemistry*; 278(5): 3466-3473 (Jan. 31, 2003).

Clynes, R., et al., "Fc receptors are required in passive and active immunity to melanoma," *Proc. Natl. Acad. Sci.*; 95: 652-656 (Jan. 1998).

Clynes, R. A., et al., "Inhibitory Fc receptors modulate in vivo cytoxicity against tumor targets," *Nature Medicine*; 6(4): 443-446 (Apr. 2000).

Holash, J., et al., "VEGF-Trap: A VEGF blocker with potent antitumor effects," *PNAS*; 99(17): 11393-11398 (Aug. 20, 2002).

Russo, R. C., et al., "The CXCL8/IL-8 chemokine family and its receptors in inflammatory diseases," *Expert Rev. Clin. Immunol.*; 10(5): 593-619 (2014).

De Groot, A. S., et al., "Reducing risk, improving outcomes: Bioengineering less immunogenic protein therapeutics," *Clinical Immunology*; 131: 189-201 (2009).

International Search Report, dated Mar. 15, 2016, issued in connection with corresponding International Application No. PCT/JP2015/006323.

Idusogie, E. E., et al., "Mapping of the C1q Binding Site on Rituxan, a Chimeric Antibody with a Human IgG1 Fc," *The Journal of Immunology*; 164: 4178-4184 (2000).

Reichert, J. M., et al., "Monoclonal antibody successes in the clinic," *Nature Biotechnology*; 23(9); 1073-1078 (Sep. 2005).

Pavlou, A. K., et al., "The therapeutic antibodies market to 2008," *Eur. J. Pharm. & Biopharm.*; 59: 389-396 (2005).

Rajpal, A., et al., "A general method for greatly improving the affinity of antibodies by using combinatorial libraries," *Proc. Natl. Acad. Sci.*; 102(24): 8466-8471 (Jun. 14, 2005).

Igawa, T., et al., "Antibody recycling by engineered pH-dependent antigen binding improves the duration of antigen neutralization," *Nature Biotechnology*; 28(11): 1203-1208 (Nov. 2010).

Scappaticci, F. A., et al., "Arterial Tromboembolic Events in Patients with Metastatic Carcinoma Treated with Chemotherapy and Bevacizumab," *J. Natl. Cancer Inst.*; 99(16): 1232-1239 (Aug. 15, 2007).

Mackay, M., et al., "Selective dysregulation of the FcγIIB receptor on memory B cells in SLE," *The Journal of Experimental Medicine*; 203(9): 2157-2164 (Sep. 4, 2006).

Meyer, T., et al., "Bevacizumab immune complexes activate platelets and induce thrombosis in FCGR2A transgenic mice," *J. Thromb. Haemost.*; 7: 171-181 (2008).

Duffau, P., et al., "Platelet CD154 Potentiates Interferon-α Secretion by Plasmacytoid Dendritic Cells in Systemic Lupus Erythematosus," *Science Translational Medicine*; 2(47): 1-10 (incl. Supplementary Materials) (Sep. 1, 2010).

Bruhns, P., "Properties of mouse and human IgG receptors and their contribution to disease models," *Blood*; 119(24): 5640-5649 (Jun. 14, 2012).

Hjelm, F., et al., "Antibody-Mediated Regulation of the Immune Response," *Scandinavian Journal of Immunology*; 64: 177-184 (2006).

Wernersson, S., et al., "IgG-Mediated Enhancement of Antibody Responses Is Low in Rc Receptor γ Chain-Deficient Mice and Increased in FcγRII-Deficient Mice," *The Journal of Immunology*; 163: 618-622 (1999).

Office Action dated Feb. 11, 2016 for commonly-owned U.S. Appl. No. 14/422,207.

Office Action dated Feb. 12, 2016 for commonly-owned U.S. Appl. No. 13/595,139.

Shields, R. L., et al., "High Resolution Mapping of the Binding Site on Human IgG1 for FcγRI, FcγRIII, and FcRn and Design of IgG1 Variants with Improved Binding to the FcγR," *The Journal of Biological Chemistry*; 276(9): 6591-6604 (Mar. 2, 2001).

Balint, R. F., et al., "Antibody engineering by parsimonious mutagenesis," *Gene*; 137: 109-118 (1993).

Sondermann, P., et al., "The 3.2-Å crystal structure of the human IgG1 Fc fragment-FcγRIII complex," *Nature*; 406: 267-273 (Jul. 20, 2000).

Office Action dated Apr. 4, 2016, 2016 for commonly-owned U.S. Appl. No. 14/001,218.

Applicant-Initiated Interview Summary dated Jan. 12, 2017, in U.S. Appl. No. 14/001,218, Mimoto, F., et al., filed Dec. 2, 2013.

Office Action dated Dec. 16, 2016, in U.S. Appl. No. 14/001,218, Mimoto, F., et al., filed Dec. 2, 2013.

Office Action dated Dec. 2, 2016, in U.S. Appl. No. 14/001,218, Mimoto, F., et al., filed Dec. 2, 2013.

Office Action dated Jan. 9, 2017, in U.S. Appl. No. 14/347,321, Igawa, T., et al., filed Mar. 26, 2014.

Restriction Requirement, dated Dec. 22, 2016 in U.S. Appl. No. 14/379,825, Igawa, T., et al., filed Aug. 20, 2014.

Restriction Requirement dated Dec. 2, 2015, in U.S. Appl. No. 14/001,218, Mimoto, F., et al., filed Dec. 2, 2013.

Wang, W., et al., "Monoclonal Antibodies with Identical Fc Sequences can Bind to FcRn Differentially with Pharmacokinetic Consequences," *Drug Metabolism and Disposition* 39(9):1469-1477, American Society for Pharmacology and Experimental Therapeutics, United States (2011).

Office Action dated Nov. 23, 2016, in U.S. Appl. No. 13/595,139, Igawa, et al., filed Aug. 27, 2012.

Office Action dated Nov. 25, 2016, in U.S. Appl. No. 13/889,484, Igawa, et al., filed May 8, 2013.

Office Action dated Nov. 28, 2016, in U.S. Appl. No. 13/889,512, Igawa, et al., filed May 8, 2013.

Tarditi, L., et al., "Selective high-performance liquid chromatographic purification of bispecific monoclonal antibodies," *J. Chromatogr.*; 599(1-2): 13-20 (1992).

Adams, C.W., et al., "Humanization of a Recombinant Monoclonal Antibody to Produce a Therapeutic Her Dimerization Inhibitor, Pertuzumab," Cancer Immunology, Immunotherapy 55(6):717-727, Springer International, Germany (2006).

Algonomics—TripoleR applications [Online] Retrieved from the Internet on Feb. 29, 2012, http://www.algonomics.com/proteinengineering/tripole_plications.php, 2 pages (Feb. 21, 2009).

Almagro, J.C. and Fransson, J., "Humanization of Antibodies," Frontiers in Bioscience 13:1619-1633, Frontiers in Bioscience Publications, United States (2008).

Amersham Biosciences: Affinity Chromatography: Principles and Methods, 2002:16-8,137.

Armour, K.L., et al., "Recombinant Human IgG Molecules Lacking Fc? Receptor I Binding and Monocyte Triggering Activities," European Journal of Immunology 29(8):2613-2624, Wiley-VCH, Germany (1999).

Bartelds, G.M., et al., "Clinical Response to Adalimumab: Relationship to Anti-adalimumab Antibodies and Serum Adalimumab Concentrations in Rheumatoid Arthritis," Annals of the Rheumatic Diseases 66(7):921-926, BMJ, England (2007).

Batra, S.K., et al., "Pharmacokinetics and Biodistribution of Genetically Engineered Antibodies," Current Opinion in Biotechnology 13(6):603-608, Current Biology, England (2002).

Bayry, J., et al., "Immuno Affinity Purification of Foot and Mouth Disease Virus Type Specific Antibodies Using Recombinant Protein Adsorbed to Polystyrene," Journal of Virological Methods 81(1-2):21-30, North-Holland Biomedical Press, Netherlands (1999).

Beck, A., et al., "Strategies and Challenges for the Next Generation of Therapeutic Antibodies," Nature Reviews. Immunology 10(5):345-352, Nature Publishing Group, England (2010).

Bender, N.K., et al., "Immunogenicity, Efficacy and Adverse Events of Adalimumab in RA Patients," Rheumatology International 27(3):269-274, Springer International, Germany (2007).

(56) References Cited

OTHER PUBLICATIONS

Binz, H.K., et al., "Engineering Novel Binding Proteins from Nonimmunoglobulin Domains," Nature Biotechnology 23(10):1257-1268, Nature America Publishing, United States (2005).
Brown, M., et al., "Tolerance to Single, but Not Multiple, Amino Acid Replacements in AntibodyVH CDR2: A Means of Minimizing B Cell Wastage from Somatic Hypermutation?," Journal of Immunology 156(9):3285-3291, American Association of Immunologists, United States (1996).
Brown, N.L., "A Study of the Interactions between an IgG-Binding Domain Based on the B Domain of Staphylococcal Protein A and Rabbit IgG," Molecular Biotechnology 10(1):9-16, Humana Press, Totowa, New Jersey (1998).
Burmeister, W.P., et al., "Crystal Structure of the Complex of Rat Neonatal Fc Receptor with Fc," Nature 372(6504):379-383, Nature Publishing Group, England (1994).
Cartron, G., et al., "Therapeutic Activity of Humanized Anti-cd20 Monoclonal Antibody and Polymorphism in IgG Fc Receptor FcgammaRIIIa Gene," Blood 99(3):754-758, American Society of Hematology, United States (2002).
Chaparro-Riggers, J., et al., "Increasing Serum Half-life and Extending Cholesterol Lowering in Vivo by Engineering Antibody With pH-sensitive Binding to PCSK9," The Journal of Biological Chemistry 287(14):11090-11097, American Society for Biochemistry and Molecular Biology, United States (2012).
Chau, L.A., et al., "HuM291(Nuvion), a Humanized Fc Receptor-Nonbinding Antibody Against CD3, Anergizes Peripheral Blood T Cells as Partial Agonist of the T Cell Receptor," Transplantation 71(7):941-950, Lippincott Williams & Wilkins, United States (2001).
Chen, C., et al., "Defective Secretion of an Immunoglobulin Caused by Mutations in the Heavy Chain Complementarity Determining Region 2," The Journal of Experimental Medicine 180(2):577-586, Rockefeller University Press, United States (1994).
Chen, C., et al., "Generation and Analysis of Random Point Mutations in an Antibody CDR2 Sequence: Many Mutated Antibodies Lose Their Ability to Bind Antigen," The Journal of Experimental Medicine 176(3):855-866, Rockefeller University Press, United States (1992).
Chen, Y., et al., "Selection and Analysis of an Optimized Anti-VEGF Antibody: Crystal Structure of an Affinity-matured Fab in Complex with Antigen," Journal of Molecular Biology 293(4):865-881, Academic Press, England (1999).
Chirino, A.J., et al., "Minimizing the Immunogenicity of Protein therapeutics," Drug Discovery Today 9(2):82-90, Elsevier Science Ltd., England (2004).
Chu, G.C., et al., "Accumulation of Succinimide in a Recombinant Monoclonal Antibody in Mildly Acidic Buffers Under Elevated Temperatures," Pharmaceutical Research 24(6):1145-1156, Kluwer Academic, United States (2007).
Cole, M.S., et al., "Human IgG2 Variants of Chimeric Anti-CD3 are Nonmitogenic to T Cells," Journal of Immunology 159(7):3613-3621, American Association of Immunologists, United States (1997).
Comper, W.D. and Glasgow, E.F., "Charge Selectivity in Kidney Ultrafiltration," Kidney International 47(5):1242-1251, Elsevier, England (1995).
Cordoba, A.J., et al., "Non-Enzymatic Hinge Region Fragmentation of Antibodies in Solution," Journal of Chromatography. B, Analytical Technologies in the Biomedical and Life Sciences 818(2):115-121, Elsevier, Netherlands (2005).
Couto, J.R., et al., "Anti-BA46 Monoclonal Antibody Mc3: Humanization Using a Novel Positional Consensus and In Vivo and In Vitro Characterization," Cancer Research 55(8):1717-1722, American Association for Cancer Research, United States (1995).
Cuatrecasas, P., and Anfinsen, C.B., "Affinity Chromatography," Methods in Enzymology 12:345-378 (1971).
Dall Acqua, W.F., et al., "Increasing the Affinity of a Human IgG1 for the Neonatal Fc Receptor: Biological Consequences," The Journal of Immunology 169(9):5171-5180, American Association of Immunologists, United States (2002).
Dall'Acqua, W.F., et al., "Antibody Humanization by Framework Shuffling," Methods 36(1):43-60, Academic Press, United States (2005).
Damschroder, M.M., et al., "Framework Shuffling of Antibodies to Reduce Immunogenicity and Manipulate Functional and Biophysical Properties," Molecular Immunology 44(11):3049-3060, Pergamon Press, England (2007).
Datta-Mannan, A., et al., "Monoclonal Antibody Clearance. Impact of Modulating the Interaction of IgG With the Neonatal Fc Receptor," The Journal of Biological Chemistry 282(3):1709-1717, American Society for Biochemistry and Molecular Biology, United States (2003).
De Groot, A.S., et al., "De-immunization of Therapeutic Proteins by T-cell Epitope Modification," Developments in Biologicals 122:171-194, Karger, Switzerland (2005).
Declaration of Dr. Nimish Gera, submitted in Opposition of EP Patent No. 2 275 443, filed Sep. 1, 2016, 24 pages.
Deen, W.M., et al., "Structural Determinants of Glomerular Permeability," American Journal of Physiology 281(4):F579-F596, American Physiological Society, United States (2001).
Del Rio, G., et al., "An Engineered Penicillin Acylase With Altered Surface Charge Is More Stable in Alkaline pH," Annals of the New York Academy of Sciences 799:61-64, Blackwell, United States (1996).
Devanaboyina, S.C., et al., "The Effect of pH Dependence of Antibody-antigen Interactions on Subcellular Trafficking Dynamics," mAbs 5(6):851-859, Taylor & Francis, United States. (2013).
Drake, A.W., and Papalin, G.A., "Biophysical Considerations for Development of Antibody-Based Therpeutics," 2012, Chapter 5, 95-97.
Durkee. K.H., et al., "Immunoaffinity Chromatographic Purification of Russell's Viper Venom Factor X Activator Using Elution in High Concentrations of Magnesium Chloride," Protein Expression and Purification 4(5):405-411, Academic Press, United States (1993).
Ejima D., et al., "Effective Elution of Antibodies by Arginine and Arginine Derivatives in Affinity Column Chromatography," Analytical biochemistry 345(2):250-257, Academic Press, United States (2005).
Ewert S., et al., "Stability Improvement of Antibodies for Extracellular and intracellular Applications: Cdr Grafting to Stable Frameworks and Structure-Based Framework Engineering," Molecular and cellular biology 34(2):184-199, Academic Press, United States (2004).
Feinberg, H., et al., "Mechanism of pH-dependent N-acetylgalactosamine Binding by a Functional Mimic of the Hepatocyte Asialoglycoprotein Receptor," The Journal of Biological Chemistry 275(45):35176-35184, American Society for Biochemistry and Molecular Biology, United States (2000).
Finkelman, F.D., et al., "Anti-cytokine Antibodies as Carrier Proteins. Prolongation of in Vivo Effects of Exogenous Cytokines by Injection of Cytokine-anti-cytokine Antibody Complexes," Journal of Immunology 151(3):1235-1244, American Association of Immunologists, United States (1993).
Fujii, I., et al., "Antibody Affinity Maturation by Random Mutagenesis," Methods in Molecular Biology 248:345-359, Humana Press, United States (2004).
Gerstner, R.B., et al., "Sequence Plasticity in the Antigen-binding Site of a Therapeutic Anti-HER2 Antibody," Journal of Molecular Biology 321(5):851-862, Elsevier, England (2002).
Gessner, J.E., et al., "The IgG Fc Receptor Family," Annals of Hematology 76(6):231-248, Springer International, Germany (1998).
Ghetie, V. and Ward, E.S., "FcRn: the MHC Class I-Related Receptor that is More Than an IgG Transporter," Immunology Today 18(12):592-598, Elsevier Science Publishers, England (1997).
Ghetie, V., et al., "Multiple Roles for the Major Histocompatibility Complex Class I-Related Receptor FcRn," Annual Review of Immunology 18:739-766, Annual Review, United States (2000).
Gobburu, J.V., et al., "Pharmacokinetics/Dynamics of 5c8, A Monoclonal Antibody to CD154 (CD40 Ligand) Suppression of an

(56) References Cited

OTHER PUBLICATIONS

Immune Response in Monkeys," Journal of Pharmacology and Experimental Therapeutics 286(2):925-930, American Society for Pharmacology and Experimental Therapeutics, United States (1998).
Goode, N.P., et al., "The Glomerular Basement Membrane Charge-selectivity Barrier: an Oversimplified Concept?," Nephrology, Dialysis, Transplantation 11(9):1714-1716, Springer International, England (1996).
Graves, S.S., et al., "Molecular Modeling and Preclinical Evaluation of the Humanized NR-LU-13 Antibody," Clinical Cancer Research 5(4):899-908, The Association, United States (1999).
Guyre, PM et al., "Increased potency of Fc-receptor-targeted antigens," Cancer Immunology, Immunotherapy 45(3-4):146-148, Springer International, Germany (1997).
Hanson, C.V., et al., "Catalytic Antibodies and their Applications," Current Opinion in Biotechnology 16(6):631-636, Elsevier, England (2005).
He, X.Y., et al., "Humanization and Pharmacokinetics of a Monoclonal Antibody with Specificity for both E- and P-Selectin," Journal of Immunology 160(2):1029-1035, American Association of Immunologists, United States (1998).
Hinton, P.R., et al., "Engineered Human IgG Antibodies With Longer Serum Half-lives in Primates," The Journal of Biological Chemistry 279(8):6213-6216, American Society for Biochemistry and Molecular Biology, United States (2004).
Horton, H.M., et al., "Potent in Vitro and in Vivo Activity of an Fc-engineered Anti-CD19 Monoclonal Antibody Against Lymphoma and Leukemia," Cancer Research 68(19):8049-8057, American Association for Cancer Research, United States (2008).
Hwang, W.Y., et al., "Use of Human Germline Genes in a CDR Homology-Based Approach to Antibody Humanization," Methods 36(1):35-42, Academic Press, United States (2005).
Igawa, "Antibody Optimization Technologies for Developing Next Generation Antibody Therapeutics," Bioindustry 28(7):15-21 (2011).
Igawa, T., et al., "Engineered Monoclonal Antibody With Novel Antigen-Sweeping Activity in Vivo," PloS One 8(5):e63236, Public Library of Science, United States (2013).
Igawa, T., et al., "Engineering the Variable Region of Therapeutic IgG Antibodies," mAbs 3(3):243-252, Taylor & Francis, United States. (2011).
Igawa, T., et al., "Reduced Elimination of IgG Antibodies by Engineering the Variable Region," Protein Engineering, Design & Selection 23(5):385-392, Oxford University Press, England (2010).
Ishii-Watabe, A., et al., "FcRn, a Critical Regulator of Antibody Pharmacokinetics," Nihon Yakurigaku Zasshi 136(5):280-284, Nippon Yakuri Gakkai, (2010).
Ito, W., et al., "The His-probe Method: Effects of Histidine Residues Introduced Into the Complementarity-determining Regions of Antibodies on Antigen-antibody Interactions at Different pH Values," FEBS Letters 309(1):85-88, John Wiley & Sons, England (1992).
Johnson, K.A., et al., "Cation Exchange-HPLC and Mass Spectrometry Reveal C-Terminal Amidation of an IgG1 Heavy Chain," Analytical Biochemistry 360(1):75-83, Academic Press, United States (2007).
Jones, T.D., et al., "Identification and Removal of a Promiscuous CD4+ T Cell Epitope from the C1 Domain of Factor VIII," Journal of Thrombosis and Haemostasis 3(5):991-1000, Blackwell Pub, England (2005).
Junghans, R.P. and Anderson, C.L., "The Protection Receptor for IgG Catabolism Is the Beta2-microglobulin-containing Neonatal Intestinal Transport Receptor," Proceedings of the National Academy of Sciences of the USA 93(11):5512-5516, National Academy of Sciences, United States (1996).
Kashmiri, S.V., et al., "Generation, Characterization, and In Vivo Studies of Humanized Anticarcinoma Antibody CC49," Hybridoma 14(5):461-473, Mary Ann Liebert, United States (1995).
Katayose, Y., et al., "MUC1-Specific Targeting Immunotherapy with Bispecific Antibodies: Inhibition of Xenografted Human Bile Duct Carcinoma Growth," Cancer Research 56(18):4205-4212, American Association for Cancer Research, United States (1996).
Khawli, L.A., et al., "Improved Tumor Localization and Radioimaging with Chemically Modified Monoclonal Antibodies," Cancer Biotherapy and Radiopharmaceuticals 11(3):203-215, Liebert, United States (1996).
Kim, I., et al., "Lowering of pI by Acylation Improves the Renal Uptake of 99mTc-Labeled anti-Tac dsFv: Effect of Different Acylating Reagents," Nuclear Medicine and Biology 29(8):795-801, Elsevier, United States (2002).
Kim, I.S., et al., "Chemical Modification to Reduce Renal Uptake of Disulfide-bonded Variable Region Fragment of Anti-tac Monoclonal Antibody Labeled With 99mTc," Bioconjugate Chemistry 10(3):447-453, American Chemical Society, United States (1999).
Kobayashi, H., et al., "The Pharmacokinetic Characteristics of Glycolated Humanized Anti-tac Fabs Are Determined by their Isoelectric Points," Cancer Research 59(2):422-430, American Association for Cancer Research, United States (1999).
Kobayashi, T., et al., "A Monoclonal Antibody Specific for a Distinct Region of Hen Egg-white Lysozyme," Molecular Immunology 19(4):619-630, Pergamon Press, England (1982).
Komissarov, A.A., et al., "Site-specific Mutagenesis of a Recombinant Anti-single-stranded DNA Fab. Role of Heavy Chain Complementarity-determining Region 3 Residues in Antigen Interaction," 272(43):26864-26870, American Society for Biochemistry and Molecular Biology, United States (1997).
Laitinen, O.H., et al., "Brave New (Strept)Avidins in Biotechnology," Trends in Biotechnology 25(6):269-277, Elsevier Science, England (2007).
Lee, C.V., et al., "High-affinity Human Antibodies From Phage-displayed Synthetic Fab Libraries With a Single Framework Scaffold," Journal of Molecular Biology 340(5):1073-1093, Academic Press, England (2004).
Leong, S.R., et, al., "Adapting Pharmacokinetic Properties of a Humanized Anti-Interleukin-8 Antibody for Therapeutic Applications Using Site-Specific Pegylation," Cytokine 16(3):106-119, Elsevier Science Ltd., England (2001).
Lin, Y.S., et al., "Preclinical Pharmacokinetics, Interspecies Scaling, and Tissue Distribution of a Humanized Monoclonal Antibody Against Vascular Endothelial Growth Factor," The Journal of Pharmacology and Experimental Therapeutics 288(1):371-378, American Society for Pharmacology and Experimental Therapeutics, United States (1999).
Linder, M., et al., "Design of a pH-Dependent Cellulose-Binding Domain," FEBS Letters 447(1):13-16, North-Holland on behalf of the Federation of European Biochemical Societies, Amsterdam (1999).
Liu, H., et al., "Heterogeneity of Monoclonal Antibodies," Journal of Pharmaceutical Sciences 97(7):2426-2447, Wiley-Liss, United States (2008).
Lobo, E.D., et al., "Antibody Pharmacokinetics and Pharmacodynamics," Journal of Pharmaceutical Sciences 93(11):2645-2668, Wiley-Liss, United States (2004).
Lund, J., et al., "Multiple Binding Sites on the CH2 Domain of IgG for Mouse Fc Gamma R," Molecular Immunology 29(1):53-59, Pergamon Press, England (1992).
Maccallum, R.M., et al., "Antibody-Antigen Interactions: Contact Analysis and Binding Site Topography," Journal of Molecular Biology 262(5):732-745, Elsevier, England (1996).
Maeda, K., et al., "pH-Dependent Receptor/ligand Dissociation as a Determining Factor for Intracellular Sorting of Ligands for Epidermal Growth Factor Receptors in Rat Hepatocytes," Journal of Controlled Release 82(1):71-82, Elsevier Science, Netherlands (2002).
Maini, R.N., et al, "Double-blind Randomized Controlled Clinical Trial of the Interleukin-6 Receptor Antagonist, Tocilizumab, in European Patients With Rheumatoid Arthritis Who Had an Incomplete Response to Methotrexate," 54(9):2817-2829, Wiley-Blackwell, United States (2006).
Marshall, S.A., et al., "Rational Design and Engineering of Therapeutic Proteins," Drug Discovery Today 8(5):212-221, Elsevier Science Ltd, Irvington, New Jersey (2003).

(56) References Cited

OTHER PUBLICATIONS

Martin, W.L., et al., "Crystal Structure at 2.8 A of an FcRn/Heterodimeric Fc Complex: Mechanism of pH-Dependent Binding," Molecular Cell 7(4):867-877, Cell Press, United States (2001).
Matsumiya, S., et al., "Structural Comparison of Fucosylated and Nonfucosylated Fc Fragments of Human Immunoglobulin G1,"Journal of Molecular Biology368(3):767-779,Elsevier, England (2007).
Maxfield, F.R. and McGraw, T.E., "Endocytic Recycling," Nature Reviews 5(2):121-132, Nature Publishing Group, England (2004).
Mi, W., et al., "Targeting the Neonatal Fc Receptor for Antigen Delivery using Engineered Fc Fragments," Journal of Immunology 181(11):7550-7561, American Association of Immunologists, United States (2008).
Mohan, et al CALBIOCHEM Buffers, "A guide for the preparation and use of buffers in biological systems," by chandra Mohan, Ph.D.,Copyright 2003 EMD Biosciences, Inc.,an Affliate of Merck K GaA, Darmastadt, Germany ,37pages (CALBIOCHEM Buffers Booklet, 2003).
Montero-Julian, F.A., et al., "Pharmacokinetic Study of Anti-interleukin-6 (IL-6) Therapy With Monoclonal Antibodies: Enhancement of IL-6 Clearance by Cocktails of Anti-il-6 Antibodies," Blood 85(4):917-924, American Society of Hematology, United States (1995).
Murtaugh, M.L., et al., "A Combinatorial Histidine Scanning Library Approach to Engineer Highly pH-dependent Protein Switches," Protein Science 20(9):1619-1631, Cold Spring Harbor Laboratory Press, United States (2011).
Nesterova, A., et al., "Glypican-3 as a novel target for an antibody-drug conjugate," AACR Annual Meeting Apr. 14-18, 2007, Abstract No. 656, (2007).
Nimmerjahn, F. and Ravetch, J.V., "Divergent Immunoglobulin G Subclass Activity Through Selective Fc Receptor Binding," Science 310(5753):1510-1512, American Association for the Advancement of Science, United States (2005).
Nishimoto, N. and Kishimoto, T., "Interleukin 6: From Bench to Bedside," Nature Clinical Practice. Rheumatology 2(11):619-626, Nature Publishing Group, United States (2006).
Nishimoto, N., et al., "Humanized Anti-interleukin-6 Receptor Antibody Treatment of Multicentric Castleman Disease," Blood 106(8):2627-2632, American Society of Hematology, United States (2005).
Nordlund, H.R., et al., "Introduction of Histidine Residues Into Avidin Subunit Interfaces Allows pH-dependent Regulation of Quaternary Structure and Biotin Binding," FEBS Letters 555(3):449-454, John Wiley & Sons Ltd, England (2003).
Ono, K., et al., "The Humanized Anti-HM1.24 Antibody Effectively Kills Multiple Myeloma Cells by Human Effector Cell-Mediated Cytotoxicity," Molecular Immunology 36(6):387-395, Pergamon Press, England (1999).
Pakula, A.A. and Sauer, R.T., "Genetic Analysis of Protein Stability and Function," Annual Review of Genetics 23:289-310, Annual Reviews, United States (1989).
Palladino, M.A., et al, "Anti-TNF-Alpha Therapies: the Next Generation," Nature Reviews Drug Discovery 2(9):736-746, Nature Publishing Group, England (2003).
Pardridge, W.M., et al., "Enhanced Endocytosis in Cultured Human Breast Carcinoma Cells and In Vivo Biodistribution in Rats of a Humanized Monoclonal Antibody After Cationization of the Protein," Journal of Pharmacology and Experimental Therapeutics 286(1):548-554, American Society for Pharmacology and Experimental Therapeutics, United States (1998).
Pavlinkova, G., et al., "Charge-modified Single Chain Antibody Constructs of Monoclonal Antibody CC49: Generation, Characterization, Pharmacokinetics, and Biodistribution Analysis," Nuclear Medicine and Biology 26(1):27-34, Elsevier, United States (1999).
Poduslo, J. F. and Curran, G. L., "Polyamine Modification Increases the Permeability of Proteins at the Blood-Nerve and Blood-Brain Barriers," Journal of Neurochemistry 66(4):1599-1609, Blackwell Science, England (1996).
Pons, J., et al., "Energetic Analysis of an Antigen/Antibody Interface: Alanine Scanning Mutagenesis and Double Mutant Cycles on the HyHEL-10/lysozyme Interaction," 8(5):958-968, Cold Spring Harbor Laboratory Press, United States (1999).
Presta, L.G., "Engineering of Therapeutic Antibodies to Minimize Immunogenicity and Optimize Function," Advanced Drug Delivery Reviews 58(5-6):640-656, Elsevier Science, Netherlands (2006).
Rathanaswami, P., et al., "Demonstration of an in Vivo Generated Sub-picomolar Affinity Fully Human Monoclonal Antibody to Interleukin-8," Biochemical and Biophysical Research Communications 334(4):1004-1013, Elsevier, United States (2005).
Reddy M.P., et al., "Elimination of Fc Receptor-Dependent Effector Functions of a Modified IgG4 Monoclonal Antibody to Human CD4," Journal of Immunology 164(4):1925-1933, American Association of Immunologists, United States (2000).
Reichert, J.M. and Valge-Archer, V.E., "Development Trends for Monoclonal Antibody Cancer Therapeutics," Nature Reviews. Drug Discovery 6(5):349-356, Nature Pub. Group, London (2007).
Reverberi, R. and Reverberi, L., "Factors Affecting the Antigen-antibody Reaction," Blood Transfusion 5(4):227-240, SIMTI servizi, Italy (2007).
Rich, R.L. and Myska, D.G., "Grading the Commercial Optical Biosensor Literature-Class of 2008: 'The Mighty Binders'," Journal of Molecular Recognition 23(1):1-64, John Wiley & Sons, England (2010).
Rojas, J.R., et al., "Formation, Distribution, and Elimination of Infliximab and Anti-infliximab Immune Complexes in Cynomolgus Monkeys," The Journal of Pharmacology and Experimental Therapeutics 313(2):578-585, American Society for Pharmacology and Experimental Therapeutics, United States (2005).
Roopenian, D.C. and Akilesh, S., "FcRn: the Neonatal Fc Receptor Comes of Age," Nature Reviews Immunology 7(9):715-725, Nature Publishing Group, England (2007).
Rothe, A., et al., "Ribosome Display for Improved Biotherapeutic Molecules," Expert Opinion on Biological Therapy 6(2):177-187, Taylor & Francis, England (2006).
Rudikoff, S., et al., "Single Amino Acid Substitution Altering Antigen-Binding Specificity," Proceedings of the National Academy of Sciences USA 79(6):1979-1983, The National Academy of Sciences, United States (1982).
Salfeld, J.G., "Isotype Selection in Antibody Engineering," Nature Biotechnology 25(12):1369-1372, Nature America Publishing, United States (2007).
Sarkar, C.A., et al., "Rational Cytokine Design for Increased Lifetime and Enhanced Potency Using pH-activated Histidine Switching," Nature Biotechnology 20(9):908-913, Nature America Publishing, United States (2002).
Sato, K., et al., "Reshaping a Human Antibody to Inhibit the Interleukin 6-Dependent Tumor Cell Growth," Cancer Research 53(4):851-856, American Association for Cancer Research, United States (1993).
Schaeffer, R.C. Jr., et al., "The Rat Glomerular Filtration Barrier Does Not Show Negative Charge Selectivity," Microcirculation 9(5):329-342, Wiley-Blackwell, United States (2002).
Schmitz, U., et al., "Phage Display: a Molecular Tool for the Generation of Antibodies—a Review," Placenta 21 Suppl A:S106-S112, Elsevier, Netherlands (2000).
Schroeder, H.W., Jr., "Similarity and Divergence in the Development and Expression of the Mouse and Human Antibody Repertoires," Developmental & Comparative Immunology 30(1-2):119-135, Elsevier Science, Tarrytown New York (2006).
Shire, S.J., et al., "Challenges in the Development of High Protein Concentration Formulations," Journal of Pharmaceutical Sciences 93(6):1390-1402, Elsevier, United States (2004).
Siberil, S., et al., "Molecular Aspects of Human Fcgammar Interactions with IgG: Functional and Therapeutic Consequences," Immunology Letters 106(2):111-118, Elsevier/North-Holland Biomedical Press, Netherlands (2006).

(56) References Cited

OTHER PUBLICATIONS

Stearns, D.J., et al., "The Interaction of a Ca2+-dependent Monoclonal Antibody With the Protein C Activation Peptide Region. Evidence for Obligatory Ca2+ Binding to Both Antigen and Antibody," The Journal of Biological Chemistry 263(2):826-832, American Society for Biochemistry and Molecular Biology, United States (1988).

Stewart, J.D., et al., "Site-directed Mutagenesis of a Catalytic Antibody: an Arginine and a Histidine Residue Play Key Roles," Biochemistry 33(8):1994-2003, American Chemical Society, United States (1994).

Strand, V., et al., "Biologic Therapies in Rheumatology: Lessons Learned, Future Directions," Nature Reviews Drug Discovery 6(1):75-92, Nature Publishing Group, England (2007).

Suzuki, T., et al., "Importance of Neonatal FcR in Regulating the Serum Half-life of Therapeutic Proteins Containing the Fc Domain of Human IgG1: a Comparative Study of the Affinity of Monoclonal Antibodies and Fc-fusion Proteins to Human Neonatal FcR," Journal of Immunology 184(4):1968-1976, American Association of Immunologists, United States (2010).

Tabrizi, M.A., et al., "Elimination Mechanisms of Therapeutic Monoclonal Antibodies," Drug Discovery Today 11(1-2):81-88, Virgin Mailing and Distribution, England (2006).

Tan, P.H., et al., "Engineering the Isoelectric Point of a Renal Cell Carcinoma Targeting Antibody Greatly Enhances scFV Solubility," Immunotechnology 4(2):107-114, Elsevier, Netherlands (1998).

Teeling, J.L., et al., "The Biological Activity of Human CD20 Monoclonal Antibodies is Linked to Unique Epitopes on CD20," Journal of Immunology 177(1):362-371, American Association of Immunologists, United States (2006).

Ten Kate, C.I., et al., "Effect of Isoelectric Point on Biodistribution and Inflammation: Imaging With Indium-111-labelled IgG," European Journal of Nuclear Medicine 17(6-8):305-309, Springer Verlag, Germany (1990).

Tsuchiya Credit Suisse Seminar "Therapeutic Antibody" at Fuji-Gotemba Laboratories , (2006), p. 21.

Tsurushita, N., et al., "Design of Humanized Antibodies: From Anti-Tac to Zenapax," Methods 36(1):69-83, Academic Press, United States (2005).

Vaisitti, T., et al., "Cationization of Monoclonal Antibodies: Another Step Towards the "Magic Bullet"?," Journal of Biological Regulators & Homeostatic Agents 19(3-4):105-112, Biolife, Italy (2005).

Vajdos, F.F., et al., "Comprehensive Functional Maps of the Antigen-Binding Site of an Anti-ErbB2 Antibody obtained with Shotgun Scanning Mutagenesis," Journal of Molecular Biology 320(2):415-428, Elsevier Science, United States (2002).

Van Walle, I., et al., "Immunogenicity Screening in Protein Drug Development," Expert Opinion on Biological Therapy 7(3):405-418, Taylor & Francis, Taylor & Francis (2007).

Vaughn, D.E. and Bjorkman, P.J., "Structural Basis of pH-dependent Antibody Binding by the Neonatal Fc Receptor," Structure 6(1):63-73, Cell Press, United States (1998).

Veri, M.C., et al., "Monoclonal Antibodies Capable of Discriminating the Human Inhibitory Fcgamma-receptor IIB (CD32B) From the Activating Fcgamma-receptor IIA (CD32A): Biochemical, Biological and Functional Characterization," Immunology 121(3):392-404, Blackwell Scientific, England (2007).

Ward, S.L. and Ingham, K.C., "A Calcium-binding Monoclonal Antibody That Recognizes a Non-calcium-binding Epitope in the Short Consensus Repeat Units (SCRs) of Complement C1r," Molecular Immunology 29(1):83-93, Pergamon Press, England (1992).

Wiens, G.D., et al., "Mutation of a Single Conserved Residue in VH Complementarity-determining Region 2 Results in a Severe Ig Secretion Defect," Journal of Immunology 167(4):2179-2186, American Association of Immunologists, United States (2001).

Wiens, G.D., et al., "Somatic Mutation in VH Complementarity-determining Region 2 and Framework Region 2: Differential Effects on Antigen Binding and Ig Secretion," Journal of Immunology 159(3):1293-1302, American Association of Immunologists, United States (1997).

Wikipedia, "Chaotropic agent" [online], [retrieved on Nov. 2, 2015]. Retrieved from the Inernet: https://en.wikipedia.org/wiki/Chaotropic_agent.

Wojciak, J.M., et al., "The Crystal Structure of Sphingosine-1-phosphate in Complex With a Fab Fragment Reveals Metal Bridging of an Antibody and Its Antigen," Proceedings of the National Academy of Sciences of the USA 106(42):17717-17722, National Academy of Sciences, United States (2009).

Xiang, J., et al., "Study of B72.3 Combining Sites by Molecular Modeling and Site-directed Mutagenesis," Protein Engineering 13(5):339-344, Oxford University Press, England (2000).

Yamamoto, T., et al., "Molecular Studies of pH-dependent Ligand Interactions With the Low-density Lipoprotein Receptor," Biochemistry 47(44):11647-11652, American Chemical Society, United States (2008).

Yamasaki, Y., et al., "Pharmacokinetic Analysis of In Vivo Disposition of Succinylated Proteins Targeted to Liver Nonparenchymal Cells Via Scavenger Receptors: Importance of Molecular Size and Negative Charge Density for In Vivo Recognition by Receptors," Journal of Pharmacology and Experimental Therapeutics 301(2):467-477, American Society for Pharmacology and Experimental Therapeutics, United States (2002).

Yang, K., et al., "Tailoring Structure-Function and Pharmacokinetic Properties of Single-chain Fv Proteins by Site-specific PEGylation," Protein Engineering 16(10):761-770, Oxford University Press, England (2003).

Yang, W.P., et al., "Cdr Walking Mutagenesis for the Affinity Maturation of a Potent Human Anti-Hiv-1 Antibody into the Picomolar Range," Journal of Molecular Biology 254(3):392-403, Elsevier, England (1995).

Yeung, Y.A., et al., "Engineering Human IgG1 Affinity to Human Neonatal Fc Receptor: Impact of Affinity Improvement on Pharmacokinetics in Primates," Journal of Immunology 182(12):7663-7671, American Association of Immunologists, United States (2009).

Zalevsky J., et al., "The Impact of Fc Engineering on an Anti-CD19 Antibody: Increased Fcgamma Receptor Affinity Enhances B-cell Clearing in Nonhuman Primates," Blood 113(16):3735-3743, American Society of Hematology, United States (2009).

Zhou, T., et al., "Interfacial Metal and Antibody Recognition," Proceedings of the National Academy of Sciences of the USA 102(41):14575-14580, National Academy of Sciences, United States (2005).

Zhu, X., et al, "MHC Class I-related Neonatal Fc Receptor for Igg Is Functionally Expressed in Monocytes, Intestinal Macrophages, and Dendritic Cells," Journal of Immunology 166(5):3266-3276, American Association of Immunologists, United States (2001).

Zuckier, L.S., et al., "Chimeric Human-Mouse IgG Antibodies with Shuffled Constant Region Exons Demonstrate that Multiple Domains Contribute to In Vivo Half-Life," Cancer Research 58(17):3905-3908, American Association for Cancer Research, United States (1998).

Zwick, M.B., et al., "The Long Third Complementarity-determining Region of the Heavy Chain Is Important in the Activity of the Broadly Neutralizing Anti-human Immunodeficiency Virus Type 1 Antibody 2F5," Journal of Virology 78(6):3155-3161, American Society for Microbiology, United States (2004).

Hironiwa, N., et al., "Calcium-Dependent Antigen Binding As a Novel Modality for Antibody Recycling by Endosomal Antigen Dissociation," mAbs 8(1):65-73, Taylor & Francis, Philadelphia (2016).

Maier, J.K.X., et al., "Assessment of Fully Automated Antibody Homology Modeling Protocols in Molecular Operating Environment," Proteins 82(8):1599-1610, Wiley-Liss, New York (2014).

Office Action dated Feb. 7, 2017, in U.S. Appl. No. 14/422,207, Igawa, T., et al., filed Feb. 18, 2015.

Amendment and Reply to Office Action dated Nov. 23, 2016 in U.S. Appl. No. 13/595,139, filed Mar. 22, 2017, 29 pages.

Mazda, O., et al., "Regulation of Muscle Homeostasis and Metabolism by the TGF-beta Superfamily Cytokine, Myostatin/growth

(56) References Cited

OTHER PUBLICATIONS

Differentiation Factor 8 (GDF8)," Journal of Kyoto Prefectural University of Medicine 122(3):133-141 (2013).
Maurer, P.H., et al., "Antigenicity of Polypeptides (poly alpha amino acids): Calcium-dependent and Independent Antibodies," Journal of Immunology 105(3):567-573, American Association of Immunologists, United States (1970).
Amendment and Reply to Office Action dated Apr. 12, 2017 in U.S. Appl. No. 14/680,154, filed Apr. 7, 2015, 70 pages.
Amendment and Reply to Office Action dated Nov. 28, 2016 in U.S. Appl. No. 13/889 512, filed Mar. 27, 2017, 16 pages.
Ober R.J., et al., "Visualizing the Site and Dynamics of IgG Salvage by the MHC Class I-related Receptor, FcRn1," The Journal of Immunology 172(4):2021-2029, The American Association of Immunologists (2004).
Office Action dated Jan. 13, 2017, in U.S. Appl. No. 14/680,154, Hasegawa, M., et al., filed Apr. 7, 2015, 15 pages.
Kim, Y. S., et al., "Production of a Polyclonal Anti-Myostatin Antibody and the Effects on In Ovo Administration of the Antibody of Posthatch Broiler Growth and Muscle Mass," Poultry Science 86:1196-1205 (2007).
Ying, J. and Xue, L., "Large Yellow Croaker MSTN-1 Prodomain Prokaryotic Expression, Polyclonal Antibody Preparation and Antibody Function Identification," Chinese J Cell Bio 36(10):1344-1349 (2014)(Abstract).
Breitbart, A., et al., "Highly Specific Detection of Myostatin Prodomain by an Immunoradiometric Sandwich Assay in Serum of Healthy Individual Individuals and Patients," PLoS One 8(11):e80454 (2013).
Final Office Action dated Jan. 29, 2018 in U.S. Appl. No. 14/001,218, Mimoto, F., filed Dec. 2, 2013.
Search Report dated Jan. 3, 2018 in corresponding Singaporean Patent Application No. 11201700841Q, filed Dec. 18, 2015.
Borrok, M.J., et al., "ph-dependent Binding Engineering Reveals an FcRn Affinity Threshold That Governs IgG Recycling," The Journal of Biological Chemistry 290(7):4282-4290, American Society for Biochemistry and Molecular Biology, United States (2015).
Fiedler, M., et al., "An Engineered IN-1 F(ab) Fragment with Improved Affinity for the Nogo-A Axonal Growth Inhibitor Permits Immunochemical Detection and Shows Enhanced Neutralizing Activity," Protein Engineering 15(11):931-941, IRL Press, England (2002).
Foote, J. and Winter, G., "Antibody Framework Residues Affecting the Conformation of the Hypervariable Loops," Journal of Molecular Biology 224(2):487-499, Elsevier, England (1992).
Gera, N., et al., "Design of pH Sensitive Binding Proteins from the Hyperthermophilic Sso7d Scaffold," PLoS One 7(11):e48928, Public Library of Science, United States (2012).
Hong., et al., "Enhanced Cellular Uptake and Transport of Polyclonal Immunoglobulin G and Fab After Their Cationization," Journal of Drug Targeting 8(2):67-77, Informa Healthcare, England (2000).
Hoogenboom, H.R., "Selecting and Screening Recombinant Antibody Libraries," Nature Biotechnology 23(9):1105-1116, Nature America Publishing, United States (2005).
Iwabe, T., et al., "Pathogenetic Significance of Increased Levels of Interleukin-8 in the Peritoneal Fluid of Patients with Endometriosis," Fertility and Sterility 69(5):924-930, Elsevier, United States (1998).
Janeway, Immunobiology, 5th Edition, Chapter 3, Garland Science, New York (2001).
Janeway, Immunobiology, 5th Edition, Chapter 4, Garland Science, New York (2001).
Knappik, A., et al., "Fully Synthetic Human Combinatorial Antibody Libraries (HuCAL) based on Modular Consensus Frameworks and CDRs Randomized with Trinucleotides," Journal of Molecular Biology 296(1):57-86, Elsevier, England (Feb. 2000).
Muller, Y.A., et al., "VEGF and the Fab Fragment of a Humanized Neutralizing Antibody: Crystal Structure of the Complex at 2.4 A Resolution and Mutational Analysis of the Interface," Structure 6(9):1153-1167, Cell Press, United States (1998).
Murata, V.M., et al., "Anti-digoxin Fab Variants Generated by Phage Display," Molecular Biotechnology 54(2):269-277, Humana Press, United States (2013).
Non-Final Office Action dated Jun. 27, 2017 in U.S. Appl. No. 14/001,218, Futa Mimoto, filed Dec. 2, 2013.
Office Action dated Jul. 20, 2017, in U.S. Appl. No. 14/379,825, Igawa, T., et al., filed Aug. 20, 2014.
Office Action dated May 30, 2017, in U.S. Appl. No. 13/595,139, Igawa, T., et al., filed Aug. 27, 2012.
Osbourn, J.K., et al., "Generation of a Panel of Related Human scFv Antibodies With High Affinities for Human CEA," Immunotechnology 2(3):181-196, Elsevier, Netherlands (1996).
Pancook, J.D., et al., "In Vitro Affinity Maturation of Human IgM Antibodies Reactive With Tumor-associated Antigens," Hybridoma and Hybridomics 20(5-6):383-396, Mary Ann Liebert, United States (2001).
Pejchal, R., et al., "A Conformational Switch in Human Immunodeficiency Virus gp41 Revealed by the Structures of Overlapping Epitopes Recognized by Neutralizing Antibodies," Journal of Virology 83(17):8451-8462, American Society for Microbiology, United States (2009).
Raposo, B., et al., "Epitope-specific Antibody Response is Controlled by Immunoglobulin V(H) Polymorphisms," The Journal of Experimental Medicine 211(3):405-411, Rockefeller University Press, United States (2014).
Schier, R., et al., "Isolation of Picomolar Affinity anti-c-erbb-2 Single-chain Fv by Molecular Evolution of the Complementarity Determining Regions in the Center of the Antibody Binding Site," Journal of Molecular Biology 263(4):551□567, Elsevier, England (1996).
Sharifi, J., et al., "Improving Monoclonal Antibody Pharmacokinetics via Chemical Modification," The Quarterly Journal of Nuclear Medicine 42(4):242-249, Minerva Medica, Italy (1998).
Vidarsson, G., et al., "IgG Subclasses and Allotypes: from Structure to Effector Functions," Frontiers in Immunology 5(Article 520):17 pages, Lausanne: Frontiers Research Foundation, Switzerland (Oct. 2014).
Wu, H., et al., "Stepwise in Vitro Affinity Maturation of Vitaxin, an $\alpha v \beta 3$-specific Humanized mAb," Proceedings of the National Academy of Sciences USA 95(11):6037-6042, National Academy of Sciences, United States (May 1998).
Ozhegov et al., "Tolkovyi Slovar Russkogo iazyka," p. 292 (2004)(with English translation of the relevant passage defining "control").
Roitt et al.,Immunology, M., Mir.: pp. 110, 150, and 537-539 (2000)(in Russian, with what is believed to be a published English equivalent of those pages).
GE Healthcare. Application note 28-9277-92 AA. "High-throughput screening of elution pH for monoclonal antibodies on MabSelect SuRe using PreDictor plates," General Electric Company (2008).
Amersham Biosciences. Antibody Purification Handbook, Edition 18-1037-46, Amersham Biosciences AB (2002).
Sigma-Aldrich®, Product Information, Monoclonal ANTI-FLAG® M1, Clone M1, accessed at http://www.sigmaaldrich.com/content/dam/sigmaaldrich/ does/Sigma/Datasheet/f3040dat.pdf, 1 page (2008).
Coloma, M.J., et al., "Position Effects of Variable Region Carbohydrate on the Affinity and in Vivo Behavior of an Anti-(1—6) Dextran Antibody," Journal of Immunology 162(4):2162-2170, American Association of Immunologists, United States (1999).
Hamers-Casterman, C., et al., "Naturally occurring antibodies devoid of light chains," Nature 363:446-448, Nature Publishing Group (Jun. 3, 1993).
Hird, V., et al, "Tumour Localisation With a Radioactively Labelled Reshaped Human Monoclonal Antibody," British Journal of Cancer 64:911-914, Macmillan Press Ltd. (1991).
Kuroda, D., et al.,"Computer-aided antibody design," Protein Eng Des Sel, 25(10):507-521, Oxford University Press (2012).
Li, B., et al., "Construction and Characterization of a Humanized Anti-human CD3 Monoclonal Antibody 12F6 With Effective

(56) References Cited

OTHER PUBLICATIONS

Immunoregulation Functions," Immunology 116(4):487-498, Blackwell Scientific, England (2005).

Merchant, A. M., et al., "An efficient route to human bispecific IgG," Nature Biotechnology 16:677-681, Nature Publishing Group (Jul. 1998).

Pardridge, W. M., et al., "Enhanced Cellular Uptake and in Vivo Biodistribution of a Monoclonal Antibody Following Cationization," Journal of Pharmaceutical Sciences 84(8):943-948, American Chemical Society and American Pharmaceutical Association, United States (Aug. 1995).

Radaev, S., et al., "The Structure of a Human Type III Fcγ Receptor in Complex with Fc," The Journal of Biological Chemistry 276(19):16469-16477, American Society for Biochemistry and Molecular Biology, United States (2001).

Reimann, K. A., et al., "A Humanized Form of a CD4-specific Monoclonal Antibody Exhibits Decreased Antigenicity and Prolonged Plasma Half-life in Rhesus Monkeys While Retaining Its Unique Biological and Antiviral Properties," AIDS Research and Human Retroviruses 13(11):933-943, Mary Ann Liebert, Inc., United States (1997).

Singer, M., and Berg, P., "Genes & Genomes," Structure of Proteins 67-69 , University Science Books, United States (1991).

Verhoeyen, M.E., et al., "Construction of a reshaped HMFG1 antibody and comparison of its fine specificity with that of the parent mouse antibody," Immunology 78:364-370, Blackwell Scientific, England (1993).

Verhoeyen, M., et al., "Re-shaped human anti-PLAP antibodies," Chapter 5, 37-43 in Monoclonal Antibodies: Applications in Clinical Oncology, , A.A. Epenetos, Ed., Chapman and Hall (1991).

Glick, B. R., et al., "Molecular Biotechnology—Principles and Applications of Recombinant DNA," edited, p. 168, paragraph 5, Chemical Industry Press, China (Mar. 2005), with English translation thereof.

Office Action dated Apr. 4, 2016, in U.S. Appl. No. 14/001,218, Mimoto, F., filed Dec. 2, 2013.

* cited by examiner

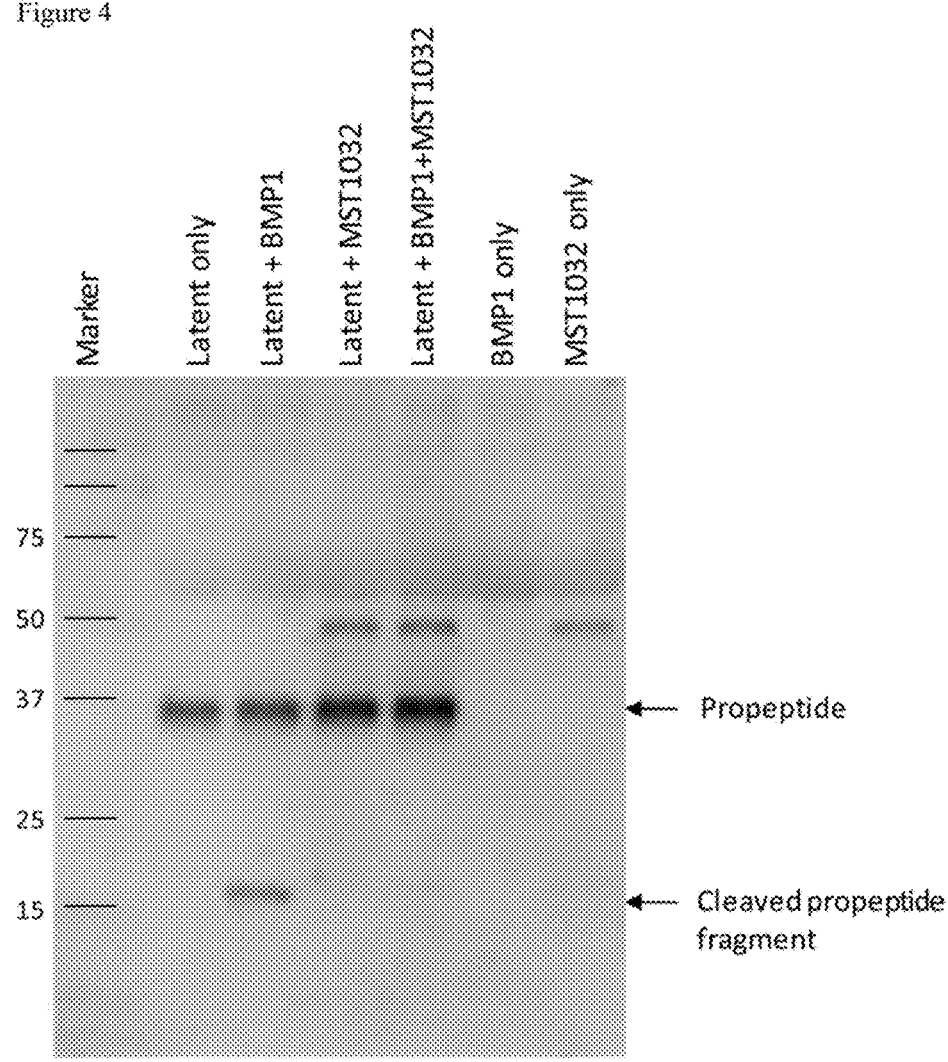

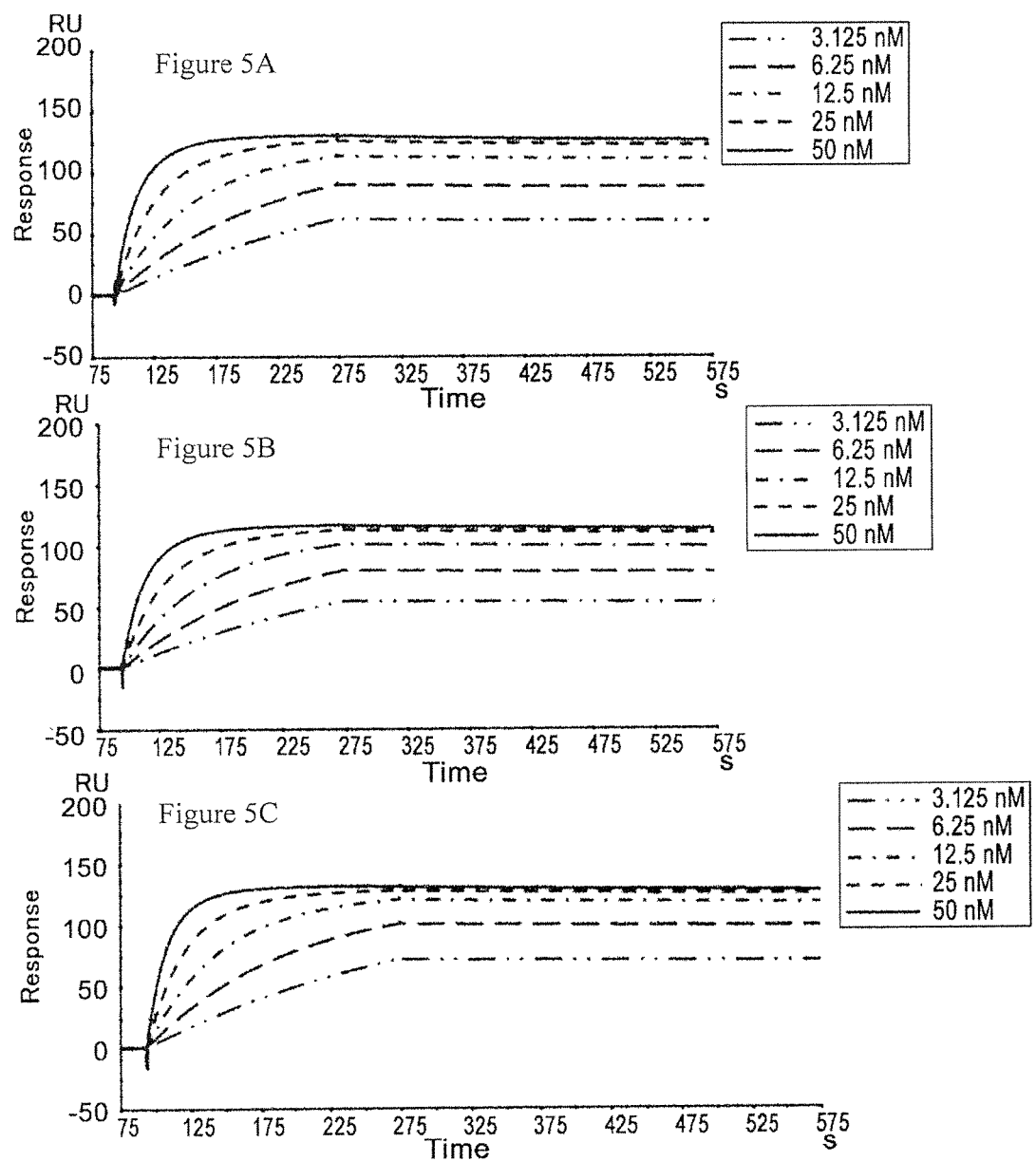

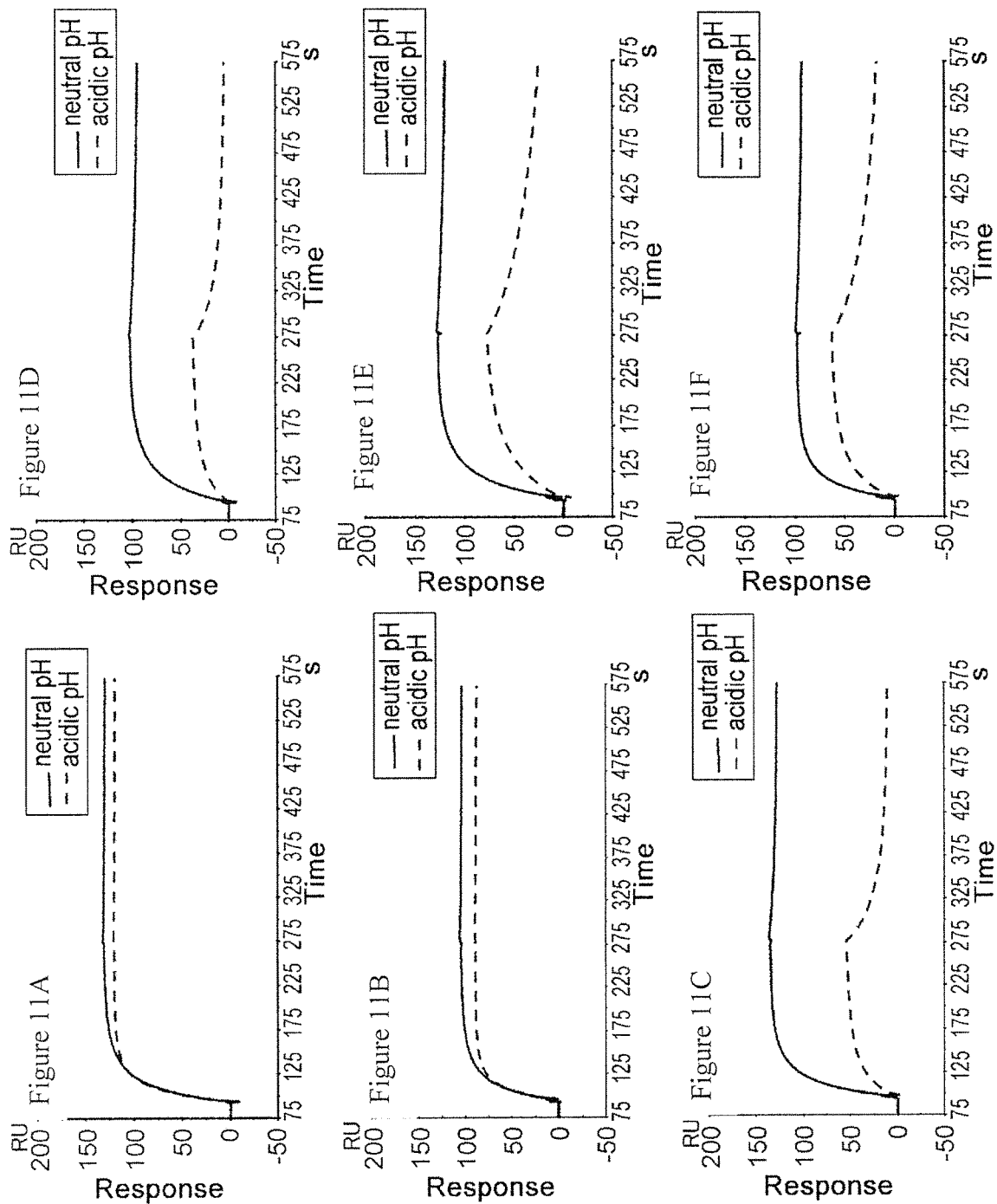

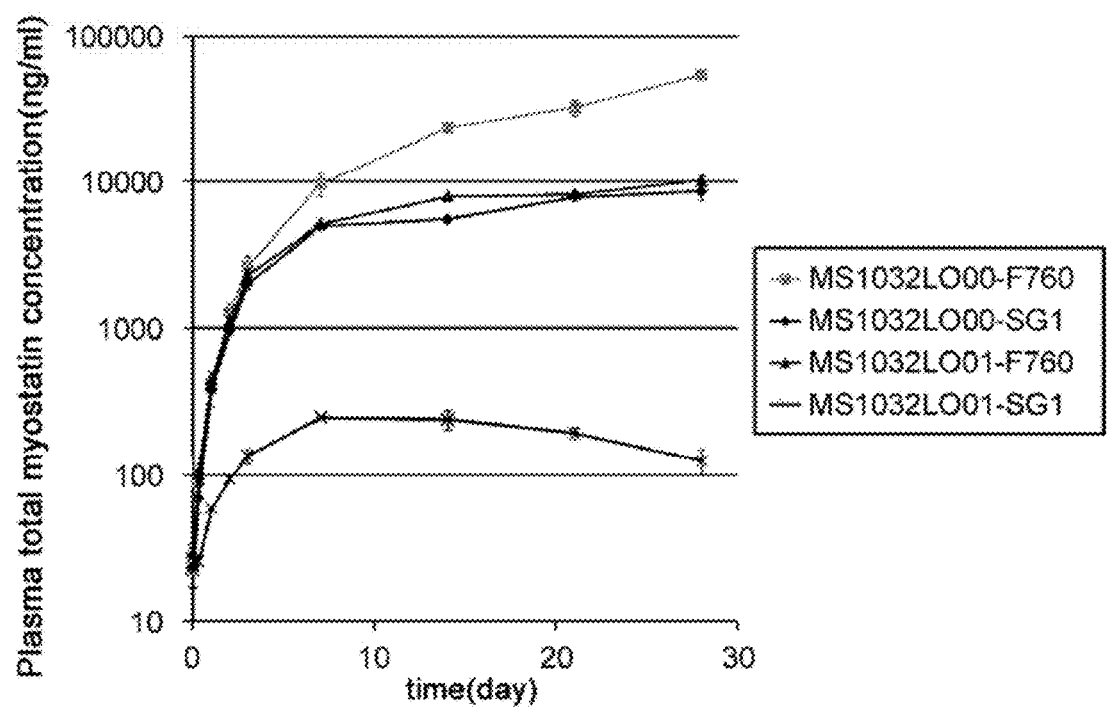

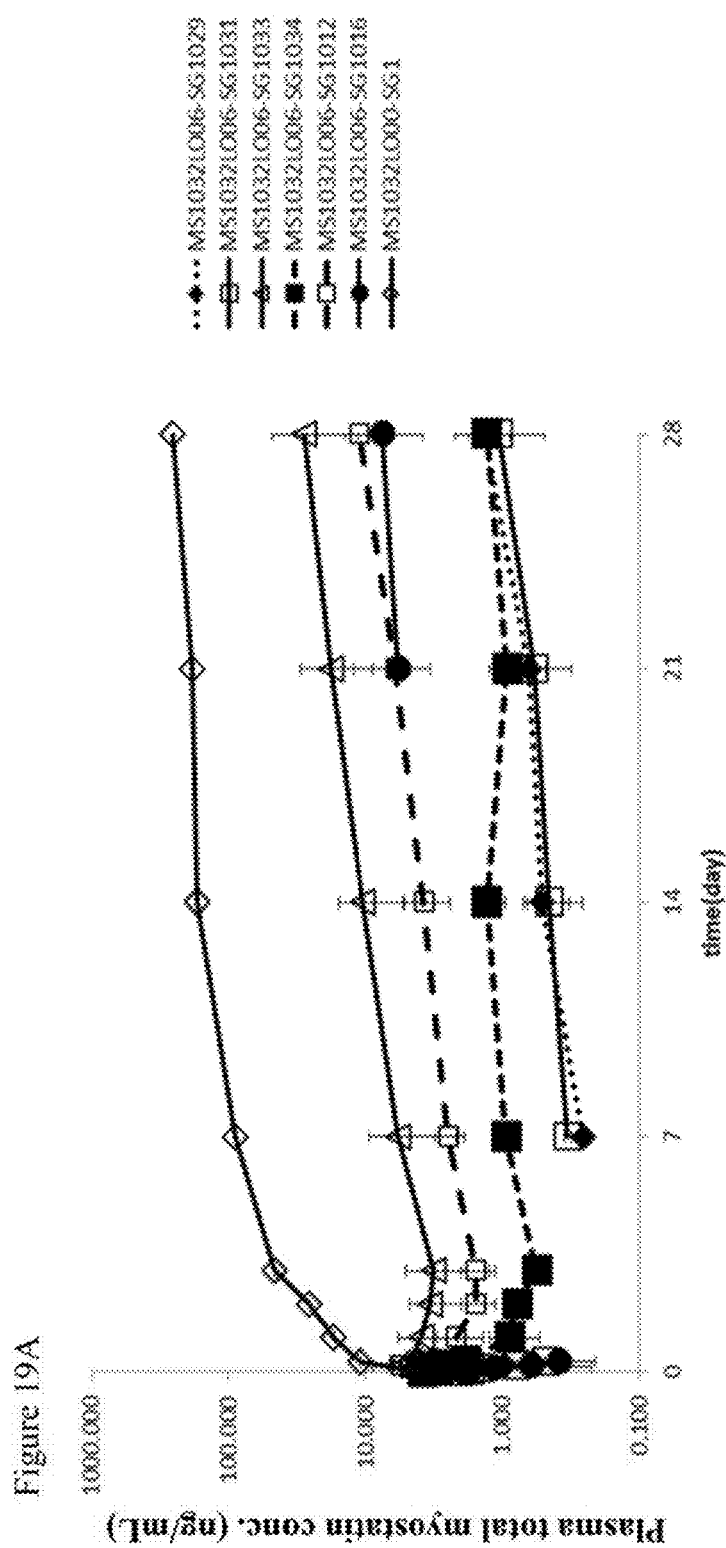

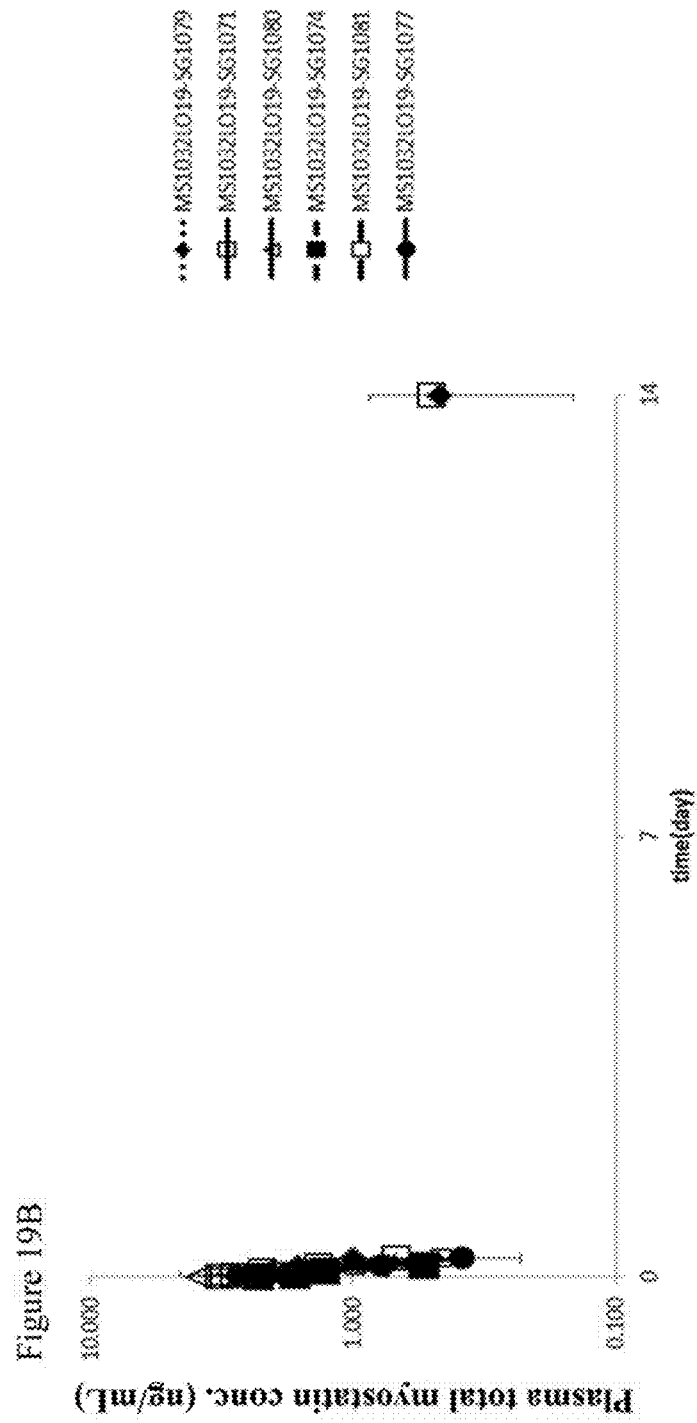

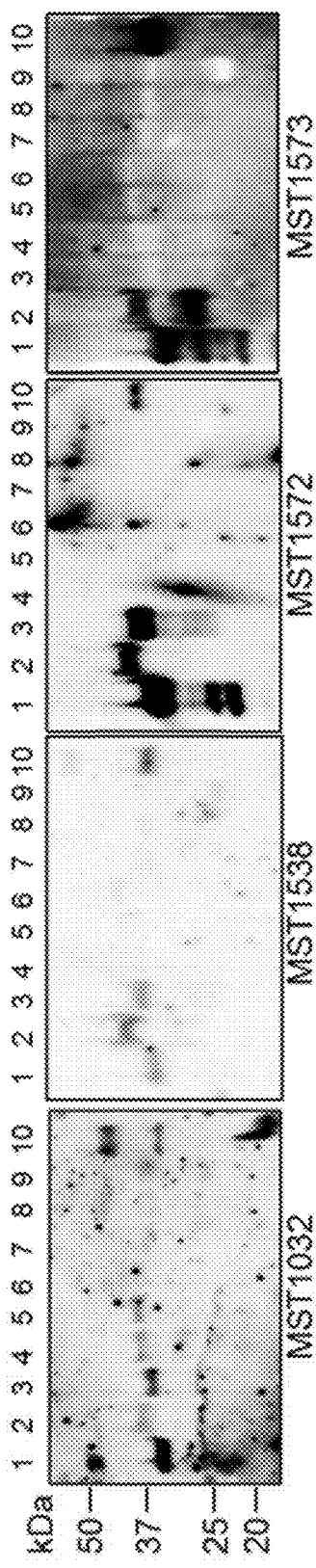

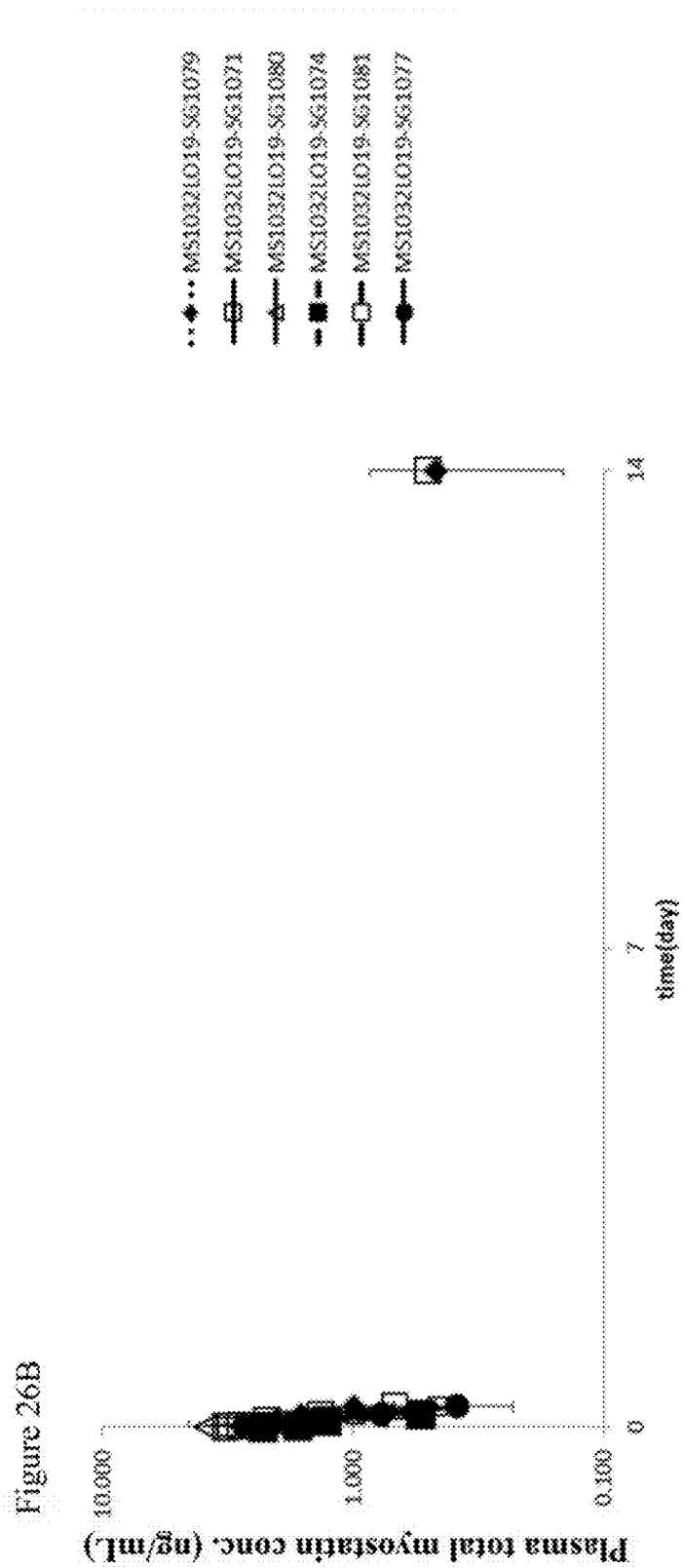

ANTI-MYOSTATIN ANTIBODIES, POLYPEPTIDES CONTAINING VARIANT FC REGIONS, AND METHODS OF USE

REFERENCE TO SEQUENCE LISTING SUBMITTED ELECTRONICALLY

The content of the electronically submitted sequence listing in ASCII text file NAME_SeqList.txt (3467.0140000 SL_ST25.txt; Size: 660,970 bytes; and Date of Creation: Dec. 18, 2015) filed with the application is herein incorporated by reference in its entirety.

BACKGROUND

The present invention relates to anti-myostatin antibodies and methods of using the same. The present invention also relates to polypeptides containing variant Fc regions and methods of using the same. Myostatin, also referred to as growth differentiation factor-8 (GDF8), is a secreted protein and is a member of the transforming growth factor-β (TGF-β) superfamily of proteins. Members of this superfamily possess growth-regulatory and morphogenetic properties (see, e.g., Kingsley et al., *Genes Dev.* 8(2):133-146 (1994), Hoodless et al., *Curr. Top. Microbiol. Immunol.* 228:235-272 (1998), and U.S. Pat. No. 5,827,733). Myostatin is expressed primarily in the developing and adult skeletal muscle and functions as a negative regulator of muscle growth. Systemic overexpression of myostatin in adult mice leads to muscle wasting (see, e.g., Zimmers et al., *Science* 296 (5572): 1486-1488 (2002)) while, conversely, a myostatin knockout mouse is characterized by hypertrophy and hyperplasia of the skeletal muscle resulting in two- to threefold greater muscle mass than their wild type littermates (see, e.g., McPherron et al., *Nature* 387(6628):83-90 (1997)).

Like other members of the TGF-β family, myostatin is synthesized as a large precursor protein containing an N-terminal propeptide domain, and a C-terminal domain considered as the active molecule (see, e.g., McPherron and Lee, *Proc. Natl. Acad. Sct. USA* 94(23): 12457-12461 (1997); WO 1994/021681). Two molecules of myostatin precursor are covalently linked via a single disulfide bond present in the C-terminal growth factor domain. Active mature myostatin (disulfide-bonded homodimer consisting of the C-terminal growth factor domain) is liberated from myostatin precursor through multiple steps of proteolytic processing. In the first step of the myostatin activation pathway, a peptide bond between the N-terminal propeptide domain and the C-terminal growth factor domain, Arg266-Asp267, is cleaved by a furin-type proprotein convertase in both chains of the homodimeric precursor. But the resulting three peptides (two propeptides and one mature myostatin (i.e., a disulfide-bonded homodimer consisting of the growth factor domains)) remain associated, forming a noncovalent inactive complex that is referred to as "latent myostatin." Mature myostatin can then be liberated from latent myostatin through degradation of the propeptide. Members of the bone morphogenetic protein 1 (BMP1) family of metalloproteinases cleave a single peptide bond within the propeptide, Arg98-Asp99, with concomitant release of mature, active myostatin, a homodimer (see, e.g., Szláma et al., *FEBS J* 280(16):3822-3839 (2013)). Moreover, the latent myostatin can be activated in vitro by dissociating the complex with either acid or heat treatment as well (see, e.g., Lee, *PloS One* 3(2):e1628 (2008)).

Myostatin exerts its effects through a transmembrane serine/threonine kinase heterotetramer receptor family, activation of which enhances receptor transphosphorylation, leading to the stimulation of serine/threonine kinase activity. It has been shown that the myostatin pathway involves an active myostatin dimer binding to the activin receptor type IIB (ActRIIB) with high affinity, which then recruits and activates the transphosphorylation of the low affinity receptor, the activin-like kinase 4 (ALK4) or activin-like kinase 5 (ALK5). It has also been shown that the proteins Smad 2 and Smad 3 are subsequently activated and form complexes with Smad 4, which are then translocated to the nucleus for the activation of target gene transcription. It has been demonstrated that ActRIIB is able to mediate the influence of myostatin in vivo, as expression of a dominant negative form of ActRIIB in mice mimics myostatin gene knockout (see, e.g., Lee, *Proc. Natl. Acad. Sci. USA* 98(16):9306-9311 (2001)).

A number of disorders or conditions are associated with muscle wasting (i.e., loss of or functional impairment of muscle tissue), such as muscular dystrophy (MD; including Duchenne muscular dystrophy), amyotrophic lateral sclerosis (ALS), muscle atrophy, organ atrophy, frailty, congestive obstructive pulmonary disease (COPD), sarcopenia, and cachexia resulting from cancer or other disorders, as well as renal disease, cardiac failure or disease, and liver disease. Patients will benefit from an increase in muscle mass and/or muscle strength; however, there are presently limited treatments available for these disorders. Thus, due to its role as a negative regulator of skeletal muscle growth, myostatin becomes a desirable target for therapeutic or prophylactic intervention for such disorders or conditions, or for monitoring the progression of such disorders or conditions. In particular, agents that inhibit the activity of myostatin may be therapeutically beneficial.

Inhibition of myostatin expression leads to both muscle hypertrophy and hyperplasia (McPherron et al., *Nature* 387(6628):83-90 (1997)). Myostatin negatively regulates muscle regeneration after injury and lack of myostatin in myostatin null mice results in accelerated muscle regeneration (see, e.g., McCroskery et al., *J Cell Sci.* 118(15):3531-3541 (2005)). Anti-myostatin (GDF8) antibodies described in, e.g., U.S. Pat. Nos. 6,096,506, 7,261,893, 7,320,789, 7,807,159, and 7,888,486, and WO 2005/094446, WO 2007/047112, and WO 2010/070094 have been shown to bind to myostatin and inhibit myostatin activity in vitro and in vivo, including myostatin activity associated with the negative regulation of skeletal muscle mass. Myostatin-neutralizing antibodies increase body weight, skeletal muscle mass, and muscle size and strength in the skeletal muscle of wild type mice (see, e.g., Whittemore et al., *Biochem. Biophys. Res. Commun.* 300(4):965-971 (2003)) and the mdx mice, a model for muscular dystrophy (see, e.g., Bogdanovich et al., *Nature* 420(6914):418-421 (2002); Wagner., *Ann. Neurol.* 52(6):832-836 (2002)). However, these prior art antibodies are all specific for mature myostatin but not for latent myostatin, and the strategies described for inhibiting myostatin activity have utilized antibodies that can bind to and neutralize mature myostatin.

Antibodies are drawing attention as pharmaceuticals since they are highly stable in blood and have few side effects (see, e.g., Reichert et al., *Nat. Biotechnol.* 23:1073-1078 (2005) and Pavlou et al., *Eur. J. Pharm. Biopharm.* 59:389-396 (2005)). Almost all therapeutic antibodies currently on the market are antibodies of the human IgG1 subclass. One of the known functions of IgG class antibodies is antibody-dependent cell-mediated cytotoxicity (hereinafter denoted as ADCC activity) (see, e.g., Clark et al., *Chem. Immunol.* 65:88-110 (1997)). For an antibody to exhibit ADCC activity, the antibody Fc region must bind to an Fcγ receptor (hereinafter denoted as FcγR) which is an antibody-binding receptor present on the surface of effector cells such as killer cells, natural killer cells, and activated macrophages.

In humans, the FcγRIa (CD64A), FcγRIIa (CD32A), FcγRIIb (CD32B), FcγRIIIa (CD16A), and FcγRIIIb (CD16B) isoforms have been reported as the FcγR protein family, and the respective allotypes have also been reported (see, e.g., Jefferis et al., Immunol. Lett. 82:57-65 (2002)). FcγRIa, FcγRIIa, and FcγRIIIa are called activating FcγR since they have immunologically active functions, and FcγRIIb is called inhibitory FcγR since it has immunosuppressive functions (see, e.g., Smith et al., Nat. Rev. Immunol. 10:328-343 (2010)).

In the binding between the Fc region and FcγR, several amino acid residues in the antibody hinge region and CH2 domain, and a sugar chain attached to Asn at position 297 (EU numbering) bound to the CH2 domain have been shown to be important (see, e.g., Radaev et al., J. Biol. Chem. 276:16478-16483 (2001), Greenwood et al., Eur. J. Immunol. 23:1098-1104 (1993), and Morgan et al., Immunology 86:319-324 (1995)). Various variants having FcγR-binding properties, mainly antibodies with mutations introduced into these sites, have been studied so far; and Fc region variants having higher binding activities towards activating FcγR have been obtained (see, e.g., WO 2000/042072, WO 2006/019447, WO 2004/099249, and WO 2004/029207).

When an activating FcγR is cross-linked with an immune complex, it phosphorylates immunoreceptor tyrosine-based activating motifs (ITAMs) contained in the intracellular domain or FcR common γ-chain (an interaction partner), activates a signal transducer SYK, and triggers an inflammatory immune response by initiating an activation signal cascade (see, e.g., Nimmerjahn et al., Nat. Rev. Immunol. 8:34-47 (2008)).

FcγRIIb is the only FcγR expressed on B cells (see, e.g., Amigorena et al., Eur. J. Immunol. 19:1379-1385 (1989)). Interaction of the antibody Fc region with FcγRIIb has been reported to suppress the primary immune response of B cells (see, e.g., Sinclair, J. Exp. Med. 129:1183-1201 (1969)). Furthermore, it is reported that when FcγRIIb on B cells and B cell receptor (BCR) are cross-linked via an immune complex in blood, B cell activation and antibody production by B cells is suppressed (see, e.g., Heyman, Immunol. Lett. 88:157-161 (2003)). In this immunosuppressive signal transduction mediated by BCR and FcγRIIb, the immunoreceptor tyrosine-based inhibitory motif (ITIM) contained in the intracellular domain of FcγRIIb is necessary (see, e.g., Amigorena et al., Science 256:1808-1812 (1992) and Muta et al., Nature 368:70-73 (1994)). When ITIM is phosphorylated upon signaling, SH2-containing inositol polyphosphate 5-phosphatase (SHIP) is recruited, transduction of other activating FcγR signal cascades is inhibited, and inflammatory immune response is suppressed (see, e.g., Ravetch, Science 290:84-89 (2000)). Furthermore, aggregation of FcγRIIb alone has been reported to transiently suppress calcium influx due to BCR cross-linking and B cell proliferation in a BCR-independent manner without inducing apoptosis of IgM-producing B cells (see, e.g., Fournier et al., J. Immunol. 181:5350-5359 (2008)).

FcγRIIb is also expressed on dendritic cells, macrophages, activated neutrophils, mast cells, and basophils. FcγRIIb inhibits the functions of activating FcγR such as phagocytosis and release of inflammatory cytokines in these cells, and suppresses inflammatory immune responses (see, e.g., Smith et al., Nat. Rev. Immunol. 10:328-343 (2010)).

The importance of immunosuppressive functions of FcγRIIb has been elucidated so far through studies using FcγRIIb knockout mice. There are reports that in FcγRIIb knockout mice, humoral immunity is not appropriately regulated (see, e.g., J. Immunol. 163:618-622 (1999)), sensitivity towards collagen-induced arthritis (CIA) is increased (see, e.g., Yuasa et al., J. Exp. Med. 189:187-194 (1999)), lupus-like symptoms are presented, and Goodpasture's syndrome-like symptoms are presented (see, e.g., Nakamura et al., J. Exp. Med. 191:899-906 (2000)).

Additionally, regulatory inadequacy of FcγRIIb has been reported to be related to human autoimmnue diseases. For example, the relationship between genetic polymorphism in the transmembrane region and promoter region of FcγRIIb, and the frequency of development of systemic lupus erythematosus (SLE) (see, e.g., Blank, Hum. Genet. 117:220-227 (2005), Olferiev et al., J. Biol. Chem. 282:1738-1746 (2007), Chen et al., Arthritis Rheum. 54:3908-3917 (2006), Floto et al., Nat. Med. 11:1056-1058 (2005), and Li et al., J. Immunol. 176:5321-5328 (2006)), and decrease of FcγRIIb expression on the surface of B cells in SLE patients (see, e.g., Mackay et al., J. Exp. Med. 203:2157-2164 (2006) and Yang et al., J. Immunol. 178:3272-3280 (2007)) have been reported.

From mouse models and clinical findings as such, FcγRIIb is considered to play the role of controlling autoimmune diseases and inflammatory diseases through involvement in particular with B cells, and it is a promising target molecule for controlling autoimmune diseases and inflammatory diseases.

IgG1, mainly used as a commercially available therapeutic antibody, is known to bind not only to FcγRIIb, but also strongly to activating FcγR (see, e.g., Bruhns et al., Blood 113:3716-3725 (2009)). It may be possible to develop therapeutic antibodies having greater immunosuppressive properties compared with those of IgG1, by utilizing an Fc region with enhanced FcγRIIb binding, or improved FcγRIIb-binding selectivity compared with activating FcγR. For example, it has been suggested that the use of an antibody having a variable region that binds to BCR and an Fc with enhanced FcγRIIb binding may inhibit B cell activation (see, e.g., Chu et al., Mol. Immunol. 45:3926-3933 (2008)). It has been reported that crosslinking FcγRIIb on B cells and IgE bound to a B-cell receptor suppresses differentiation of B cells into plasma cells, which as a result causes suppression of IgE production; and in human PBMC-transplanted mice, human IgG and IgM concentrations are maintained whereas the human IgE concentration is decreased (see, e.g., Chu et al., J. Allergy Clin. Immunol. 129:1102-1115 (2012)). Besides IgE, it has been reported that when FcγRIIB and CD79b which is a constituent molecule of a B-cell receptor complex are cross-linked by an antibody, B cell proliferation is suppressed in vitro, and arthritis symptoms are alleviated in the collagen arthritis model (see, e.g., Veri et al., Arthritis Rheum. 62:1933-1943 (2010)).

Besides B cells, it has been reported that crosslinking of FcεRI and FcγRIIb on mast cells using molecules, in which the Fc portion of an IgG with enhanced FcγRIIb binding is fused to the Fc portion of IgE that binds to an IgE receptor FcεRI, causes phosphorylation of FcγRIIb, thereby suppressing FcεRI-dependent calcium influx. This suggests that inhibition of degranulation via FcγRIIb stimulation is possible by enhancing FcγRIIb binding (see, e.g., Cemerski et al., Immunol. Lett. 143:34-43 (2012)).

Accordingly, an antibody having an Fc with improved FcγRIIb-binding activity is suggested to be promising as a therapeutic agent for inflammatory diseases such as an autoimmune disease.

Furthermore, it has been reported that activation of macrophages and dendritic cells via Toll-like receptor 4 due to LPS stimulation is suppressed in the presence of an antibody-antigen immune complex, and this effect is also suggested to be actions of the immune complex via FcγRIIb (see, e.g., Wenink et al., *J. Immunol.* 183:4509-4520 (2009) and Zhang et al., *J. Immunol.* 182:554-562 (2009)). Therefore, use of antibodies with enhanced FcγRIIb binding is expected to enable enhancement of TLR-mediated activation signal-suppressing actions; thus such antibodies have been suggested as being promising as therapeutic agents for inflammatory diseases such as autoimmune diseases.

Additionally, mutants with enhanced FcγRIIb binding have been suggested to be promising therapeutic agents for cancer, as well as therapeutic agents for inflammatory diseases such as autoimmune diseases. So far, FcγRIIb has been found to play an important role in the agonistic activity of agonist antibodies against the anti-TNF receptor superfamily. Specifically, it has been suggested that interaction with FcγRIIb is required for the agonistic activity of antibodies against CD40, DR4, DR5, CD30, and CD137, which are included in the TNF receptor family (see, e.g., Ravetch, *Science* 333:1030-1034 (2011), Wilson et al., *Cancer Cell* 19:101-113 (2011), Kohrt et al., *J. Clin. Invest.* 122:1066-1075 (2012), Xu et al., *J. Immunol.* 171:562-568 (2003), Zhang et al., *Blood* 108:705-710 (2006), Chuntharapai et al., *J. Immunol.* 166:4891-4898 (2001) and Ravetch et al., *Proc. Natl. Acad. Sci. USA* 109:10966-10971 (2012)). Ravetch, *Science* 333:1030-1034 (2011) shows that the use of antibodies with enhanced FcγRIIb binding enhances the antitumor effect of anti-CD40 antibodies. Accordingly, antibodies with enhanced FcγRIIb are expected to have an effect of enhancing agonistic activity of agonist antibodies including antibodies against the anti-TNF receptor superfamily.

In addition, it has been shown that cell proliferation is suppressed when using an antibody that recognizes Kit, a type of receptor tyrosine kinase (RTK), to crosslink FcγRIIb and Kit on Kit-expressing cells. Similar effects have been reported even in cases where this Kit is constitutively activated and has mutations that cause oncogenesis (see, e.g., Cemerski et al., *Immunol. Lett.* 143:28-33 (2002)). Therefore, it is expected that use of antibodies with enhanced FcγRIIb binding may enhance inhibitory effects on cells expressing RTK having constitutively activated mutations.

Antibodies having an Fc with improved FcγRIIb-binding activity have been reported (see, e.g., Chu et al., *Mol. Immunol.* 45:3926-3933 (2008)). In this Literature, FcγRIIb-binding activity was improved by adding alterations such as S267E/L328F, G236D/S267E, and S239D/S267E to an antibody Fc region. Among them, the antibody introduced with the S267E/L328F mutation most strongly binds to FcγRIIb, and maintains the same level of binding to FcγRIa and FcγRIIa type H in which a residue at position 131 of FcγRIIa is His as that of a naturally-occurring IgG1. However, another report shows that this alteration enhances the binding to FcγRIIa type R in which a residue at position 131 of FcγRIIa is Arg several hundred times to the same level of FcγRIIb binding, which means the FcγRIIb-binding selectivity is not improved in comparison with type-R FcγRIIa (see, e.g., US Appl. Publ. No. US2009/0136485).

Only the effect of enhancing FcγRIIa binding and not the enhancement of FcγRIIb binding is considered to have influence on cells such as platelets which express FcγRIIa but do not express FcγRIIb (see, e.g., Smith et al., *Nat. Rev. Immunol.* 10:328-343 (2010)). For example, the group of patients who were administered bevacizumab, an antibody against VEGF, is known to have an increased risk for thromboembolism (see, e.g., Scappaticci et al., *J. Natl. Cancer. Inst.* 99:1232-1239 (2007)). Furthermore, thromboembolism has been observed in a similar manner in clinical development tests of antibodies against the CD40 ligand, and the clinical study was discontinued (see, e.g., *Arthritis Rheum.* 48:719-727 (2003)). In both cases of these antibodies, later studies using animal models and such have suggested that the administered antibodies aggregate platelets via FcγRIIa binding on the platelets, and form blood clots (see, e.g., Meyer et al., *J. Thromb. Haemost.* 7:171-181 (2008) and Robles-Carrillo et al., *J. Immunol.* 185:1577-1583 (2010)). In systemic lupus erythematosus which is an autoimmune disease, platelets are activated via an FcγRIIa-dependent mechanism, and platelet activation has been reported to correlate with the severity of symptoms (see, e.g., Duffau et al., *Sci. Transl. Med.* 2:47ra63 (2010)). Administering an antibody with enhanced FcγRIIa binding to such patients who already have a high risk for developing thromboembolism will increase the risk for developing thromboembolism, thus is extremely dangerous.

Furthermore, antibodies with enhanced FcγRIIa binding have been reported to enhance macrophage-mediated antibody dependent cellular phagocytosis (ADCP) (see, e.g., Richards et al, *Mol. Cancer Ther.* 7:2517-2527 (2008)). When antigens to be bound by the antibodies are phagocytized by macrophages, antibodies themselves are considered to be also phagocytized at the same time. When antibodies are administered as pharmaceuticals, it is supposed that peptide fragments derived from the administered antibodies are likely to be also presented as an antigen, thereby increasing the risk of production of antibodies against therapeutic antibodies (anti-therapeutic antibodies). More specifically, enhancing FcγRIIa binding will increase the risk of production of antibodies against the therapeutic antibodies, and this will remarkably decrease their value as pharmaceuticals. Furthermore, FcγRIIb on dendritic cells have been suggested to contribute to peripheral tolerance by inhibiting dendritic cell activation caused by immune complexes formed between antigens and antibodies, or by suppressing antigen presentation to T cells via activating Fcγ receptors (see, e.g., Desai et al., *J. Immunol.* 178:6217-6226 (2007)). Since FcγRIIa is also expressed on dendritic cells, when antibodies having an Fc with enhanced selective binding to FcγRIIb are used as pharmaceuticals, antigens are not readily presented by dendritic cells and such due to enhanced selective binding to FcγRIIb, and risk of anti-drug antibody production can be relatively decreased. Such antibodies may be useful in that regard as well.

More specifically, the value as pharmaceuticals will be considerably reduced when FcγRIIa binding is enhanced, which leads to increased risk of thrombus formation via platelet aggregation and increased risk of anti-therapeutic antibody production due to an increased immunogenicity.

From such a viewpoint, the aforementioned Fc variant with enhanced FcγRIIb binding shows significantly enhanced type-R FcγRIIa binding compared with that of a naturally-occurring IgG1, Therefore, its value as a pharmaceutical for patients carrying type-R FcγRIIa is considerably reduced. Types H and R of FcγRIIa are observed in Caucasians and African-Americans with approximately the same frequency (see, e.g., Salmon et al., *J. Clin. Invest.* 97:1348-1354 (1996) and Manger et al., *Arthritis Rheum.* 41:1181-

1189 (1998)). Therefore, when this Fc variant was used for treatment of autoimmune diseases, the number of patients who can safely use it while enjoying its effects as a pharmaceutical will be limited.

Furthermore, in dendritic cells deficient in FcγRIIb or dendritic cells in which the interaction between FcγRIIb and the antibody Fc portion is inhibited by an anti-FcγRIIb antibody, dendritic cells have been reported to mature (see, e.g., Boruchov et al., *J. Clin. Invest.* 115:2914-2923 (2005) and Dhodapkar et al., *Proc. Natl. Acad. Sci. USA* 102:2910-2915 (2005)). This report suggests that FcγRIIb is actively suppressing maturation of dendritic cells in a steady state where inflammation and such are not taking place and activation does not take place. FcγRIIa is expressed on the dendritic cell surface in addition to FcγRIIb; therefore, even if binding to inhibitory FcγRIIb is enhanced and if binding to activating FcγR such as FcγRIIa is also enhanced, maturation of dendritic cells may be promoted as a result. More specifically, improving not only the FcγRIIb-binding activity but also the ratio of FcγRIIb-binding activity relative to FcγRIIa-binding activity is considered to be important in providing antibodies with an immunosuppressive action.

Therefore, when considering the generation of a pharmaceutical that utilizes the FcγRIIb binding-mediated immunosuppressive action, there is a need for an Fc variant that not only has enhanced FcγRIIb-binding activity, but also has binding to both FcγRIIa types H and R allotypes, which is maintained at a similar level or is weakened to a lower level than that of a naturally-occurring IgG1.

Meanwhile, cases where amino acid alterations were introduced into the Fc region to increase the FcγRIIb-binding selectivity have been reported so far (see, e.g., Armour et al., *Mol. Immunol.* 40:585-593 (2003)). However, all variants said to have improved FcγRIIb selectivity as reported in this literature showed decreased FcγRIIb binding compared with that of a naturally-occurring IgG1. Therefore, it is considered to be difficult for these variants to actually induce an FcγRIIb-mediated immunosuppressive reaction more strongly than IgG1.

Furthermore, since FcγRIIb plays an important role in the agonist antibodies mentioned above, enhancing their binding activity is expected to enhance the agonistic activity. However, when FcγRIIa binding is similarly enhanced, unintended activities such as ADCC activity and ADCP activity will be exhibited, and this may cause side effects. Also from such viewpoint, it is preferable to be able to selectively enhance FcγRIIb-binding activity.

From these results, in producing therapeutic antibodies to be used for treating autoimmune diseases and cancer utilizing FcγRIIb, it is important that compared with those of a naturally-occurring IgG, the activities of binding to both FcγRIIa allotypes are maintained or decreased, and FcγRIIb binding is enhanced. However, FcγRIIb shares 93% sequence identity in the extracellular region with that of FcγRIIa which is one of the activating FcγRs, and they are very similar structurally. There are allotypes of FcγRIIa, H type and R type, in which the amino acid at position 131 is His (type H) or Arg (type R), and yet each of them reacts differently with the antibodies (see, e.g., Warmerdam et al., *J. Exp. Med.* 172:19-25 (1990)). Therefore, the difficult problem may be producing an Fc region variant with enhanced selective FcγRIIb binding as compared to each allotype of FcγRIIa, which involves distinguishing highly homologous sequences between FcγRIIa and FcγRIIb. In spite of those difficulties, several Fc region variants have been identified so far, which has selective binding activity to FcγRIIb as compared to FcγRIIa, by conducting comprehensive amino acid modification analysis in the Fc region (see, e.g., WO 2012/115241, WO 2013/047752, WO 2013/125667, WO 2014/030728 and WO 2014/163101).

There has been a report on an Fc region variant with binding selectivity for FcγRIIb in relation to human FcγR so far, whereas there has been no report on an Fc region variant with binding selectivity for FcγRIIb in relation to monkey FcγR. Owing to the absence of such an Fc variant, the effects of the Fc variant selectively binding to FcγRIIb have not been thoroughly tested yet in monkey.

Apart from the above, it is reported that by modifying the charge of amino acid residues which may be exposed on the surface of an antibody so as to increase or decrease the isoelectric point (pI) of the antibody, it is possible to regulate the half-life of the antibody in blood (see, e.g., WO 2007/114319 and WO 2009/041643). They show that it is possible to prolong the plasma half-life of an antibody by reducing the antibody's pI and vice versa.

Further, it is reported that incorporation of an antigen into cells can be promoted by modifying the charge of specified amino acid residues particularly in its CH3 domain to increase the antibody's pI (see, e.g., WO 2014/145159). Also, it has been reported that modifying the charge of amino acid residues in the constant region (mainly CH1 domain) of an antibody to reduce pI can prolong the half-life of the antibody in plasma (see, e.g., WO 2012/016227).

BRIEF SUMMARY

The invention provides anti-myostatin antibodies and methods of using the same. The invention also provides proteins containing a variant Fc region and methods of using the same.

In some embodiments, an isolated anti-myostatin antibody of the present invention binds to latent myostatin. In further embodiments, the antibody binds to an epitope within a fragment consisting of amino acids 21-100 of myostatin propeptide (SEQ ID NO: 78). In some embodiments, an isolated anti-myostatin antibody of the present invention inhibits activation of myostatin. In further embodiments, the antibody blocks the release of mature myostatin from latent myostatin. In further embodiments, the antibody blocks the proteolytic release of mature myostatin. In further embodiments, the antibody blocks the spontaneous release of mature myostatin. In further embodiments, the antibody does not bind to mature myostatin. In further embodiments, the antibody binds to the same epitope as an antibody described in Table 13. In further embodiments, the antibody binds to the same epitope as an antibody comprising a VH and a VL pair described in Table 13. In further embodiments, the antibody binds to the same epitope as an antibody described in Table 2a. In further embodiments, the antibody binds to the same epitope as an antibody comprising a VH and a VL pair described in Table 2a. In further embodiments, the antibody binds to the same epitope as an antibody described in Table 11a. In further embodiments, the antibody binds to the same epitope as an antibody comprising a VH and a VL pair described in Table 11a. In further embodiments, the antibody binds to the same epitope as an antibody described in Table 2a, 11a, or 13. In further embodiments, the antibody binds to the same epitope as an antibody comprising a VH and a VL pair described in Table 2a, 11a, or 13. In additional embodiments, the anti-myostatin antibody incorporate an Fc variant region provided herein, In further embodiments the anti-myostatin antibody comprises the amino acid sequence of an Fc variant region described in Section 8 below. In further embodiments the anti-myostatin antibody comprises the amino acid sequence of SEQ ID NO: 229-380, or 381.

In some embodiments, an isolated anti-myostatin antibody of the present invention binds to latent myostatin with higher affinity at neutral pH than at acidic pH. In some embodiments, the anti-myostatin antibody binds to latent myostatin with higher affinity at pH7.4 than at pH5.8. In some embodiments, an isolated anti-myostatin antibody of the present invention binds to a polypeptide fragment consisting of amino acids 21-100 of myostatin propeptide (SEQ ID NO: 78) with higher affinity at pH7.4 than at pH5.8. In some embodiments, the antibody binds to the same myostatin epitope as an antibody described in Table 13 with a higher affinity at neutral pH than at acidic pH. In additional embodiments, an anti-myostatin antibody binds to the same epitope as an antibody described in Table 13 with a higher affinity at pH7.4 than at pH5.8. In further embodiments, the antibody binds to the same epitope as an antibody comprising a VH and a VL pair described in Table 13 with a higher affinity at pH7.4 than at pH5.8. In some embodiments, the antibody binds to the same myostatin epitope as an antibody described in Table 2a with a higher affinity at neutral pH than at acidic pH. In some embodiments, the antibody binds to the same myostatin epitope as an antibody described in Table 2a with a higher affinity at pH7.4 than at pH5.8. In further embodiments, the antibody binds to the same epitope as an antibody comprising a VH and a VL pair described in Table 2a with a higher affinity at pH7.4 than at pH5.8. In additional embodiments, an anti-myostatin antibody binds to the same epitope as an antibody described in Table 11a with a higher affinity at neutral pH than at acidic pH. In further embodiments, the antibody binds to the same myostatin epitope as an antibody described in Table 11a with a higher affinity at pH7.4 than at pH5.8. In further embodiments, the antibody binds to the same epitope as an antibody comprising a VH and a VL pair described in Table 11a with a higher affinity at pH7.4 than at pH5.8. In additional embodiments, an anti-myostatin antibody binds to the same epitope as an antibody described in Table 2a, 11a, or 13 with a higher affinity at neutral pH than at acidic pH. In further embodiments, the antibody binds to the same myostatin epitope as an antibody described in Table 2a, 11a, or 13 with a higher affinity at pH7.4 than at pH5.8. In further embodiments, the antibody binds to the same epitope as an antibody comprising a VH and a VL pair described in Table 2a, 11a, or 13 with a higher affinity at pH7.4 than at pH5.8.

In some embodiments, an isolated anti-myostatin antibody of the present invention competes for binding latent myostatin with an antibody provided herein. In some embodiments, an isolated anti-myostatin antibody of the present invention competes for binding latent myostatin with an antibody described in Table 13. In some embodiments, an isolated anti-myostatin antibody of the present invention competes for binding latent myostatin with an antibody comprising a VH and VL pair described in Table 13. In some embodiments, the antibody competes for binding latent myostatin with an antibody described in Table 2a. In some embodiments, an isolated anti-myostatin antibody of the present invention competes for binding latent myostatin with an antibody comprising a VH and VL pair described in Table 2a. In some embodiments, the antibody competes for binding latent myostatin with an antibody described in Table 11a. In some embodiments, an isolated anti-myostatin antibody of the present invention competes for binding latent myostatin with an antibody comprising a VH and VL pair described in Table 11a. In additional embodiments, an anti-myostatin antibody competes for binding latent myostatin with an antibody described in Table 2a, 11a, or 13. In additional embodiments, an anti-myostatin antibody competes for binding latent myostatin with an antibody comprising a VH and VL pair described in Table 2a, 11a, or 13. In further embodiments, the anti-myostatin antibody binds to latent myostatin with a higher affinity at neutral pH than at acidic pH. In further embodiments, the anti-myostatin antibody binds to latent myostatin with a higher affinity at pH7.4 than at pH5.8. In further embodiments, the anti-myostatin antibody binds to a polypeptide fragment consisting of amino acids 21-100 of myostatin propeptide (SEQ ID NO: 78) with higher affinity at pH7.4 than at pH5.8. Methods for assessing the ability of an antibody to compete with a reference antibody for binding latent myostatin are described herein and known in the art.

In some embodiments, an isolated anti-myostatin antibody of the present invention is a monoclonal antibody. In some embodiments, an isolated anti-myostatin antibody of the present invention is a human, humanized, or chimeric antibody. In some embodiments, an isolated anti-myostatin antibody of the present invention is an antibody fragment that binds to myostatin. In some embodiments, an isolated anti-myostatin antibody of the present invention is an antibody fragment that binds to latent myostatin. In some embodiments, an isolated anti-myostatin antibody of the present invention is an antibody fragment that binds to a polypeptide fragment consisting of amino acids 21-100 of myostatin propeptide (SEQ ID NO: 78). In some embodiments, an isolated anti-myostatin antibody of the present invention is a full length IgG antibody.

In some embodiments, a anti-myostatin antibody of the invention comprises:

(a) (i) a HVR-H3 comprising the amino acid sequence GVPAX$_1$SX$_2$GGDX$_3$, wherein X$_1$ is Y or H, X$_2$ is T or H, X$_3$ is L or K (SEQ ID NO: 128), (ii) a HVR-L3 comprising the amino acid sequence AGGYGGGX$_1$YA, wherein X$_1$ is L or R (SEQ ID NO: 131), and (iii) a HVR-H2 comprising the amino acid sequence IISX$_1$AGX$_2$X$_3$YX$_4$X$_5$X$_6$WAKX$_7$, wherein X$_1$ is Y or H, X$_2$ is S or K, X$_3$ is T, M or K, X$_4$ is Y or K, X$_5$ is A, M or E, X$_6$ is S or E, X$_7$ is G or K (SEQ ID NO: 127);

(b) (i) a HVR-HI comprising the amino acid sequence X$_1$X$_2$DIS, wherein X$_1$ is S or H, X$_2$ is Y, T, D or E (SEQ ID NO: 126), (ii) a HVR-H2 comprising the amino acid sequence IISX$_1$AGX$_2$X$_3$YX$_4$X$_5$X$_6$WAKX$_7$, wherein X$_1$ is Y or H, X$_2$ is S or K, X$_3$ is T, M or K, X$_4$ is Y or K, X$_5$ is A, M or E, X$_6$ is S or E, X$_7$ is G or K (SEQ ID NO: 127), and (iii) a HVR-H3 comprising the amino acid sequence GVPAX$_1$SX$_2$GGDX$_3$, wherein X$_1$ is Y or H, X$_2$ is T or H, X$_3$ is L or K (SEQ ID NO: 128);

(c) (i) a HVR-HI comprising the amino acid sequence X$_1$X$_2$DIS, wherein X$_1$ is S or H, X$_2$ is Y, T, D or E (SEQ ID NO: 126), (ii) a HVR-H2 comprising the amino acid sequence IISX$_1$AGX$_2$X$_3$YX$_4$X$_5$X$_6$WAKX$_7$, wherein X$_1$ is Y or H, X$_2$ is S or K, X$_3$ is T, M or K, X$_4$ is Y or K, X$_5$ is A, M or E, X$_6$ is S or E, X$_7$ is G or K (SEQ ID NO: 127), (iii) a HVR-H3 comprising the amino acid sequence GVPAX$_1$SX$_2$GGDX$_3$, wherein X$_1$ is Y or H, X$_2$ is T or H, X$_3$ is L or K (SEQ ID NO: 128), (iv) a HVR-LI comprising the amino acid sequence X$_1$X$_2$SQX$_3$VX$_4$X$_5$X$_6$NWLS, wherein X$_1$ is Q or T, X$_2$ is S or T, X$_3$ is S or E, X$_4$ is Y or F, X$_5$ is D or H, X$_6$ is N, D, A or E (SEQ ID NO: 129); (v) a HVR-L2 comprising the amino acid sequence WAX$_1$TLAX$_2$, wherein X$_1$ is S or E, X$_2$ is S, Y, F or W (SEQ ID NO: 130); and (vi) a HVR-L3 comprising the amino acid sequence AGGYGGGX$_1$YA, wherein X$_1$ is L or R (SEQ ID NO: 131);

(d) (i) a HVR-L1 comprising the amino acid sequence $X_1X_2SQX_3VX_4X_5X_6NWLS$, wherein $X_1$ is Q or T, $X_2$ is S or T, $X_3$ is S or E, $X_4$ is Y or F, $X_5$ is D or H, $X_6$ is N, D, A or E (SEQ ID NO: 129); (ii) a HVR-L2 comprising the amino acid sequence $WAX_1TLAX_2$, wherein $X_1$ is S or E, $X_2$ is S, Y, F or W (SEQ ID NO: 130); and (iii) a HVR-L3 comprising the amino acid sequence $AGGYGGGX_1YA$, wherein $X_1$ is L or R (SEQ ID NO: 131). In some embodiments the antibody of (b) further comprises a heavy chain variable domain framework FR1 comprising the amino acid sequence of SEQ ID NO: 132, 133, or 134; FR2 comprising the amino acid sequence of SEQ ID NO: 135 or 136; FR3 comprising the amino acid sequence of SEQ ID NO: 137; and FR4 comprising the amino acid sequence of SEQ ID NO: 138. In some embodiments, the antibody of (d), further comprises a light chain variable domain framework FR1 comprising the amino acid sequence of SEQ ID NO: 139; FR2 comprising the amino acid sequence of SEQ ID NO: 140 or 141; FR3 comprising the amino acid sequence of SEQ ID NO: 142 or 143; and FR4 comprising the amino acid sequence of SEQ ID NO: 144. In some embodiments, the antibody further comprises a variant Fc region amino acid sequence of SEQ ID NO: 229-380, or 381.

In some embodiments, an isolated anti-myostatin antibody of the present invention comprises (a) a HVR-H3 comprising the amino acid sequence $GVPAX_1SX_2GGDX_3$, wherein $X_1$ is Y or H, $X_2$ is T or H, $X_3$ is L or K (SEQ ID NO: 128), (b) a HVR-L3 comprising the amino acid sequence $AGGYGGGX_1YA$, wherein $X_1$ is L or R (SEQ ID NO: 131), and (c) a HVR-H2 comprising the amino acid sequence $IISX_1AGX_2X_3YX_4X_5X_6WAKX_7$, wherein $X_1$ is Y or H, $X_2$ is S or K, $X_3$ is T, M or K, $X_4$ is Y or K, $X_5$ is A, M or E, $X_6$ is S or E, $X_7$ is G or K (SEQ ID NO: 127).

In some embodiments, an isolated anti-myostatin antibody of the present invention comprises (a) a HVR-H1 comprising the amino acid sequence $X_1X_2DIS$, wherein $X_1$ is S or H, $X_2$ is Y, T, D or E (SEQ ID NO: 126), (b) a HVR-H2 comprising the amino acid sequence $IISX_1AGX_2X_3YX_4X_5X_6WAKX_7$, wherein $X_1$ is Y or H, $X_2$ is S or K, $X_3$ is T, M or K, $X_4$ is Y or K, $X_5$ is A, M or E, $X_6$ is S or E, $X_7$ is G or K (SEQ ID NO: 127), and (c) a HVR-H3 comprising the amino acid sequence $GVPAX_1SX_2GGDX_3$, wherein $X_1$ is Y or H, $X_2$ is T or H, $X_3$ is L or K (SEQ ID NO: 128). In further embodiments, the antibody comprises a heavy chain variable domain framework FR1 comprising the amino acid sequence of SEQ ID NO: 132, 133, or 134; FR2 comprising the amino acid sequence of SEQ ID NO: 135 or 136; FR3 comprising the amino acid sequence of SEQ ID NO: 137; and FR4 comprising the amino acid sequence of SEQ ID NO:138. In further embodiments, the antibody additionally comprises (a) a HVR-L comprising the amino acid sequence $X_1X_2SQX_3VX_4X_5X_6NWLS$, wherein $X_1$ is Q or T, $X_2$ is S or T, $X_3$ is S or E, $X_4$ is Y or F, $X_5$ is D or H, $X_6$ is N, D, A or E (SEQ ID NO: 129); (b) a HVR-L2 comprising the amino acid sequence $WAX_1TLAX_2$, wherein $X_1$ is S or E, $X_2$ is S, Y, F or W (SEQ ID NO: 130); and (c) a HVR-L3 comprising the amino acid sequence $AGGYGGGX_1YA$, wherein $X_1$ is L or R (SEQ ID NO: 131).

In some embodiments, an isolated anti-myostatin antibody of the present invention comprises (a) a HVR-L1 comprising the amino acid sequence $X_1X_2SQX_3VX_4X_5X_6NWLS$, wherein $X_1$ is Q or T, $X_2$ is S or T, $X_3$ is S or E, $X_4$ is Y or F, $X_5$ is D or H, $X_6$ is N, D, A or E (SEQ ID NO: 129); (b) a HVR-L2 comprising the amino acid sequence $WAX_1TLAX_2$, wherein $X_1$ is S or E, $X_2$ is S, Y, F or W (SEQ ID NO: 130); and (c) a HVR-L3 comprising the amino acid sequence $AGGYGGGX_1YA$, wherein $X_1$ is L or R (SEQ ID NO: 131). In a further embodiment, the antibody further comprises a light chain variable domain framework FR comprising the amino acid sequence of SEQ ID NO: 139; FR2 comprising the amino acid sequence of SEQ ID NO: 140 or 141; FR3 comprising the amino acid sequence of SEQ ID NO: 142 or 143; and FR4 comprising the amino acid sequence of SEQ ID NO: 144.

In some embodiments, an isolated anti-myostatin antibody of the present invention comprises a heavy chain variable domain framework FR1 comprising the amino acid sequence of SEQ ID NO: 132, 133, or 134; FR2 comprising the amino acid sequence of SEQ ID NO: 135 or 136; FR3 comprising the amino acid sequence of SEQ ID NO: 137; and FR4 comprising the amino acid sequence of SEQ ID NO: 138. In some embodiments, an isolated anti-myostatin antibody of the present invention comprises a light chain variable domain framework FR1 comprising the amino acid sequence of SEQ ID NO: 139; FR2 comprising the amino acid sequence of SEQ ID NO: 140 or 141; FR3 comprising the amino acid sequence of SEQ ID NO: 142 or 143; and FR4 comprising the amino acid sequence of SEQ ID NO: 144.

In some embodiments, an isolated anti-myostatin antibody of the present invention comprises (a) a VH sequence having at least 95% sequence identity to the amino acid sequence of SEQ ID NO: 13, 16-30, 32-34, 86-94, or 95; (b) a VL sequence having at least 95% sequence identity to the amino acid sequence of SEQ ID NO: 15, 31, 35-38, 96-98, or 99; or (c) a VH sequence as in (a) and a VL sequence as in (b). In further embodiments, the antibody comprises a VH sequence of SEQ ID NO: 13, 16-30, 32-34, 86-94, or 95. In further embodiments, the antibody comprises a VL sequence of SEQ ID NO: 15, 31, 35-38, 96-98, or 99. In some embodiments, the antibody comprises a VH sequence of SEQ ID NO: 13, 16-30, 32-34, 86-94, or 95. In further embodiments, the antibody comprises a VH sequence of SEQ ID NO: 13, 16-30, 32-34, 86-94, or 95; and a VL sequence of SEQ ID NO: 15, 31, 35-38, 96-98, or 99. In some embodiments, the antibody further comprises the variant Fc region amino acid sequence of SEQ ID NO: 229-380, or 381.

In some embodiments, an isolated anti-myostatin antibody of the present invention comprises a variant Fc region provided herein. In some embodiments, the anti-myostatin antibody comprises an amino acid alteration described in Table 14-29, or 30. In some embodiments, the anti-myostatin antibody comprises the amino acid sequence of SEQ ID NO: 229-380, or 381.

The invention also provides isolated nucleic acids encoding an anti-myostatin antibody of the present invention. The invention also provides host cells comprising a nucleic acid of the present invention. The invention also provides a method of producing an antibody comprising culturing a host cell of the present invention so that the antibody is produced.

In some aspects the invention provides a method of producing an anti-myostatin antibody comprising: (a) culturing a host cell of the present invention so that the antibody is produced; or (b) immunizing an animal against a polypeptide, wherein the polypeptide comprises the region corresponding to amino acids at positions 21 to 100 of myostatin propeptide (SEQ ID NO: 78).

The invention further provides a method of producing an anti-myostatin antibody. In some embodiments, the method comprises immunizing an animal against a polypeptide, wherein the polypeptide comprises the region corresponding to amino acids at positions 21-100 of myostatin propeptide (SEQ ID NO: 78).

In some embodiments, an anti-myostatin antibody provided herein is used in a method for detecting the presence of myostatin in a biological sample. In other embodiments, an anti-myostatin antibody is used in a method of blocking the release of mature myostatin from latent myostatin in a biological sample that comprises contacting the biological sample containing latent myostatin with the antibody under conditions permissive for binding of the antibody to the latent myostatin, and blocking release of mature myostatin from the latent myostatin. In additional embodiments, an anti-myostatin antibody provided herein is used in a method of reducing the concentration of latent myostatin in a biological sample that comprises contacting the biological sample containing latent myostatin with the antibody under conditions permissive for binding of the antibody to the latent myostatin, and removing the complex formed between the antibody and the latent myostatin. In some embodiments, one or more of the above methods is performed in vitro. In some embodiments, one or more of the above methods is performed in vivo.

The invention also provides a pharmaceutical formulation comprising an anti-myostatin antibody of the present invention and a pharmaceutically acceptable carrier.

Anti-myostatin antibodies of the present invention may be for use as a medicament. In some embodiments, the antibody is used in the manufacture of a medicament for: (a) treatment of a muscle wasting disease; (b) increasing mass of muscle tissue; (c) increasing strength of muscle tissue; or (d) reducing body fat accumulation. In some embodiments, anti-myostatin antibodies of the present invention may be for use in treating a muscle wasting disease. Anti-myostatin antibodies of the present invention may be for use in increasing mass of muscle tissue. Anti-myostatin antibodies of the present invention may be for use in increasing strength of muscle tissue. Anti-myostatin antibodies of the present invention may be for use in reducing body fat accumulation.

In some embodiments, an anti-myostatin antibody provided herein has use in: (a) treating a muscle wasting disease; (b) increasing mass of muscle tissue; (c) increasing strength of muscle tissue; or (d) reducing body fat accumulation.

Anti-myostatin antibodies of the present invention may be used in the manufacture of a medicament. In some embodiments, the antibody is used in the manufacture of a medicament for: (a) treatment of a muscle wasting disease; (b) increasing mass of muscle tissue; (c) increasing strength of muscle tissue; or (d) reducing body fat accumulation In some embodiments, the medicament is for treatment of a muscle wasting disease. In some embodiments, the medicament is for increasing mass of muscle tissue. In some embodiments, the medicament is for increasing strength of muscle tissue. In some embodiments, the medicament is for reducing body fat accumulation.

The invention also provides a method of treating an individual having a muscle wasting disease. In some embodiments, the method comprises administering to the individual an effective amount of an anti-myostatin antibody of the present invention. The invention also provides a method of increasing mass of muscle tissue in an individual. In some embodiments, the method comprises administering to the individual an effective amount of an anti-myostatin antibody of the present invention to increase mass of muscle tissue. The invention also provides a method of increasing strength of muscle tissue in an individual. In some embodiments, the method comprises administering to the individual an effective amount of an anti-myostatin antibody of the present invention to increase strength of muscle tissue. The invention also provides a method of reducing body fat accumulation in an individual. In some embodiments, the method comprises administering to the individual an effective amount of an anti-myostatin antibody of the present invention to reduce body fat accumulation.

The invention provides polypeptides comprising variant Fc regions and methods of making and using the same.

In one embodiment, the invention provides FcγRIIB-binding polypeptides comprising variant Fc regions and methods of using the same. In some embodiments, a variant Fc region with enhanced FcγRIIb-binding activity of the present invention comprises at least one amino acid alteration in a parent Fc region. In further embodiments, the ratio of [KD value of the parent Fc region for monkey FcγRIIb]/[KD value of the variant Fc region for monkey FcγRIIb] is 2.0 or greater. In further embodiments, the ratio of [KD value of the parent Fc region for monkey FcγRIIIa]/[KD value of the variant Fc region for monkey FcγRIIIa] is 0.5 or smaller. In further embodiments, the ratio of [KD value of the parent Fc region for human FcγRIIb]/[KD value of the variant Fc region for human FcγRIIb] is 2.0 or greater. In further embodiments, the ratio of [KD value of the parent Fc region for human FcγRIIIa]/[KD value of the variant Fc region for human FcγRIIIa] is 0.5 or smaller. In further embodiments, the ratio of [KD value of the parent Fc region for human FcγRIIa (type H)]/[KD value of the variant Fc region for human FcγRIIa (type H)] is 5.0 or smaller. In further embodiments, the ratio of [KD value of the parent Fc region for human FcγRIIa (type R)]/[KD value of the variant Fc region for human FcγRIIa (type R)] is 5.0 or smaller. In another embodiment, the KD value of the variant Fc region for monkey FcγRIIb is $1.0 \times 10^{-6}$ M or smaller. In another embodiment, the KD value of the variant Fc region for monkey FcγRIIIa is $5.0 \times 10^{-7}$ M or greater. In another embodiment, the KD value of the variant Fc region for human FcγRIIb is $2.0 \times 10^{-6}$ M or smaller. In another embodiment, the KD value of the variant Fc region for human FcγRIIIa is $1.0 \times 10^{-6}$ M or greater. In another embodiment, the KD value of the variant Fe region for human FcγRIIa (type H) is $1.0 \times 10^{-7}$ M or greater. In another embodiment, the KD value of the variant Fc region for human FcγRIIa (type R) is $2.0 \times 10^{-7}$ M or greater.

In some embodiments, a variant Fc region with enhanced FcγRIIb-binding activity of the present invention comprises at least one amino acid alteration of at least one position selected from the group consisting of: 231, 232, 233, 234, 235, 236, 237, 238, 239, 264, 266, 267, 268, 271, 295, 298, 325, 326, 327, 328, 330, 331, 332, 334, and 396, according to EU numbering.

In further embodiments, the variant Fc region with enhanced FcγRIIb-binding activity comprises at least two amino acid alterations comprising: (a) one amino acid alteration at position 236, and (b) at least one amino acid alteration of at least one position selected from the group consisting of: (i) position 231, 232, 233, 234, 235, 237, 238, 239, 264, 266, 267, 268, 271, 295, 298, 325, 326, 327, 328, 330, 331, 332, 334, and 396; (ii) position: 231, 232, 235, 239, 268, 295, 298, 326, 330, and 396; or (iii) position 268, 295, 326, and 330; according to EU numbering.

In further embodiments, the variant Fc region with enhanced FcγRIIb-binding activity comprises at least two amino acid alterations comprising: (a) one amino acid alteration at position 236, and (b) at least one amino acid alteration of at least one position selected from the group consisting of: 231, 232, 233, 234, 235, 237, 238, 239, 264, 266, 267, 268, 271, 295, 298, 325, 326, 327, 328, 330, 331, 332, 334, and 396, according to EU numbering.

In further embodiments, the variant Fc region with enhanced FcγRIIb-binding activity comprises at least two amino acid alterations comprising: (a) one amino acid alteration at position 236, and (b) at least one amino acid alteration of at least one position selected from the group consisting of: 231, 232, 235, 239, 268, 295, 298, 326, 330, and 396, according to EU numbering.

In further embodiments, the variant Fc region with enhanced FcγRIIb-binding activity comprises at least two amino acid alterations comprising: (a) one amino acid alteration at position 236, and (b) at least one amino acid alteration of at least one position selected from the group consisting of: 268, 295, 326, and 330 according to EU numbering.

In some embodiments, a variant Fc region with enhanced FcγRIIb-binding activity of the present invention comprises at least one amino acid selected from the group consisting of: (a) Asp, Glu, Phe, Gly, His, Ile, Lys, Leu, Met, Asn, Pro, Gln, Arg, Ser, Thr, Val, Trp, Tyr at position 231; (b) Ala, Asp, Glu, Phe, Gly, His, Ile, Lys, Leu, Met, Asn, Gln, Arg, Ser, Thr, Val, Trp, Tyr at position 232; (c) Asp at position 233; (d) Trp, Tyr at position 234; (e) Trp at position 235; (f) Ala, Asp, Glu, His, Ile, Leu, Met, Asn, Gln, Ser, Thr, Val at position 236; (g) Asp, Tyr at position 237; (h) Glu, Ile, Met, Gln, Tyr at position 238; (i) Ile, Leu, Asn, Pro, Val at position 239; (j) Ile at position 264; (k) Phe at position 266; (l) Ala, His, Leu at position 267; (m) Asp, Glu at position 268; (n) Asp, Glu, Gly at position 271; (o) Leu at position 295; (p) Leu at position 298; (q) Glu, Phe, Ile, Leu at position 325; (r) Thr at position 326; (s) Ile, Asn at position 327; (t) Thr at position 328; (u) Lys, Arg at position 330; (v) Glu at position 331; (w) Asp at position 332; (x) Asp, Ile, Met, Val, Tyr at position 334; and (y) Ala, Asp, Glu, Phe, Gly, His, Ile, Lys, Leu, Met, Asn, Gln, Arg, Ser, Thr. Val, Trp, Tyr at position 396; according to EU numbering.

In further embodiments, the variant Fc region with enhanced FcγRIIb-binding activity comprises at least one amino acid selected from the group consisting of: (a) Gly, Thr at position 231; (b) Asp at position 232; (c) Trp at position 235; (d) Asn, Thr at position 236; (e) Val at position 239; (f) Asp, Glu at position 268; (g) Leu at position 295; (h) Leu at position 298; (i) Thr at position 326; (j) Lys, Arg at position 330, and (k) Lys, Met at position 396; according to EU numbering.

In another embodiment, the invention provides a polypeptide comprising an isoelectric point (pI)-increased variant Fc region and a method of using the same. In some embodiments, a polypeptide comprising a variant Fc region with increased pI comprises at least two amino acid alterations in a parent Fc region. In further embodiments, each of the amino acid alterations increases the isoelectric point (pI) of the variant Fc region compared with that of the parent Fc region. In further embodiments, the amino acid can be exposed on the surface of the variant Fc region. In further embodiments, a polypeptide comprises the variant Fc region and an antigen-binding domain. In further embodiments, antigen-binding activity of the antigen-binding domain changes according to ion concentration conditions. In further embodiments, the variant Fc region with increased pI of the present invention comprises at least two amino acid alterations of at least two positions selected from the group consisting of: 285, 311, 312, 315, 318, 333, 335, 337, 341, 342, 343, 384, 385, 388, 390, 399, 400, 401, 402, 413, 420, 422, and 431 according to EU numbering. In further embodiments, the variant Fc region with increased pI comprises Arg or Lys at each of the positions selected.

In some embodiments, a variant Fc region of the present invention comprises amino acid alterations described in Tables 14-30.

In some embodiments, a polypeptide comprises a variant Fc region of the present invention. In further embodiments, the parent Fc region is derived from human IgG1. In further embodiments, the polypeptide is an antibody. In further embodiments, the polypeptide is an Fc fusion protein.

The invention provides a polypeptide comprising the amino acid sequence of SEQ ID NO: 229-380, or 381.

The invention also provides isolated nucleic acid encoding the polypeptide comprising a variant Fc region of the present invention. The invention also provides a host cell comprising the nucleic acid of the present invention. The invention also provides a method of producing a polypeptide comprising a variant Fc region comprising culturing the host of the present invention so that the polypeptide is produced. The invention additionally provides a method of suppressing the activation of an immune cell in a biological sample comprising contacting a biological sample containing an immune cell with a polypeptide comprising a variant Fc region of the present invention.

The invention additionally provides a pharmaceutical formulation comprising the polypeptide comprising a variant Fc region of the present invention and a pharmaceutically acceptable carrier. The invention also provides methods of treatment that include but are not limited to methods of treating an individual having an immunological inflammatory disease, autoimmune disease, or viral infection that comprise administering to the individual an effective amount of a polypeptide comprising a variant Fc region provided herein.

BRIEF DESCRIPTION OF THE DRAWINGS/FIGURES

FIG. 4 illustrates Western Blot analysis against myostatin propeptide, as described in Example 6. Proteolytic cleavage of myostatin propeptide by BMP1 was assessed in the presence and absence of anti-latent myostatin antibody.

FIGS. 5A-5C illustrate BIACORE® sensorgrams of anti-latent myostatin antibody MST1032-Glm towards human latent myostatin (A), cynomolgus monkey latent myostatin (B), and mouse latent myostatin (C), as described in Example 7.

Figure 6A:
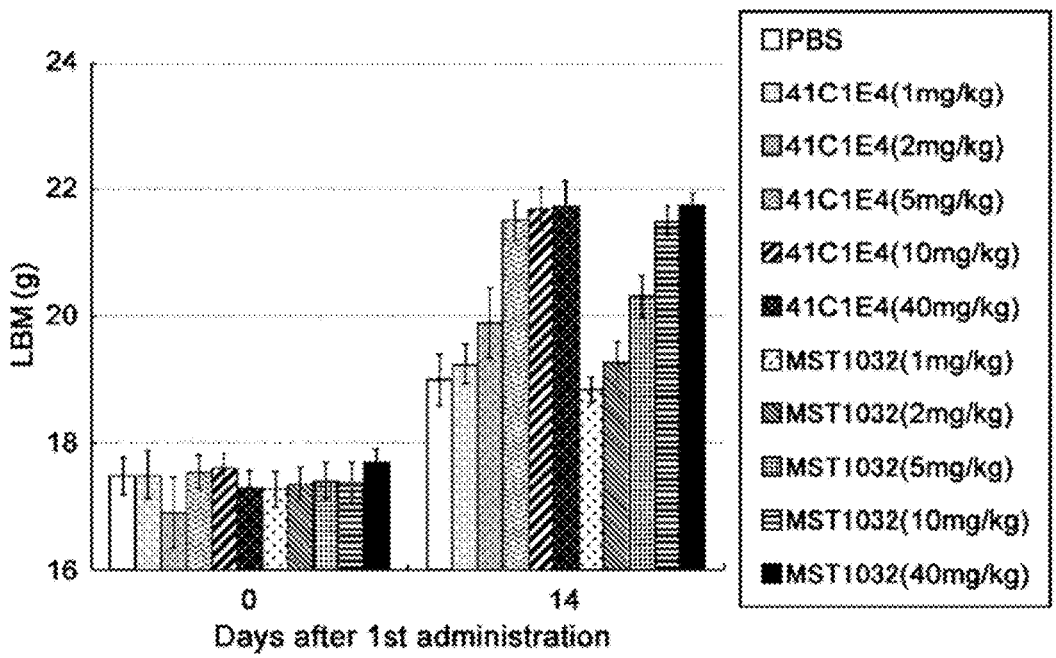
FIG. 6A illustrates in vivo efficacy of anti-latent myostatin antibody and anti-mature myostatin antibody on muscle mass and fat mass, as described in Example 8. Anti-latent myostatin antibody (MST1032-Glm; described as MST1032 in the Figures) or anti-mature myostatin antibody (41C1E4) was administered to SCID mice, and full body lean mass (LBM) was measured.
Figure 6B:
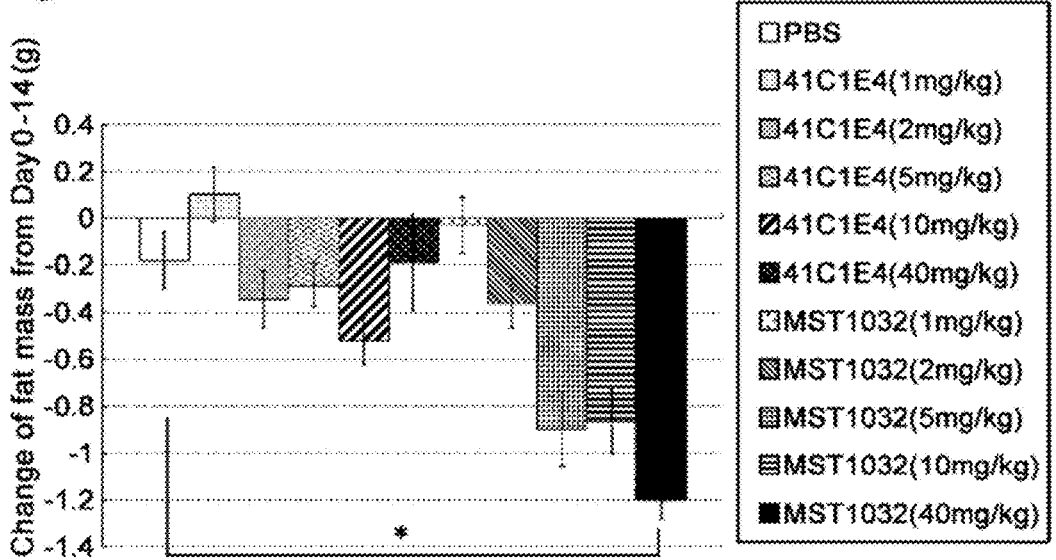

FIG. 6B illustrates in vivo efficacy of anti-latent myostatin antibody and anti-mature myostatin antibody on muscle mass and fat mass, as described in Example 8. Anti-latent myostatin antibody (MST1032-Glm; described as MST1032 in the Figures) or anti-mature myostatin antibody (41C1E4) was administered to SCID mice, and change of full body fat mass from Day 0 to Day 14 was measured.

Figure 6C:
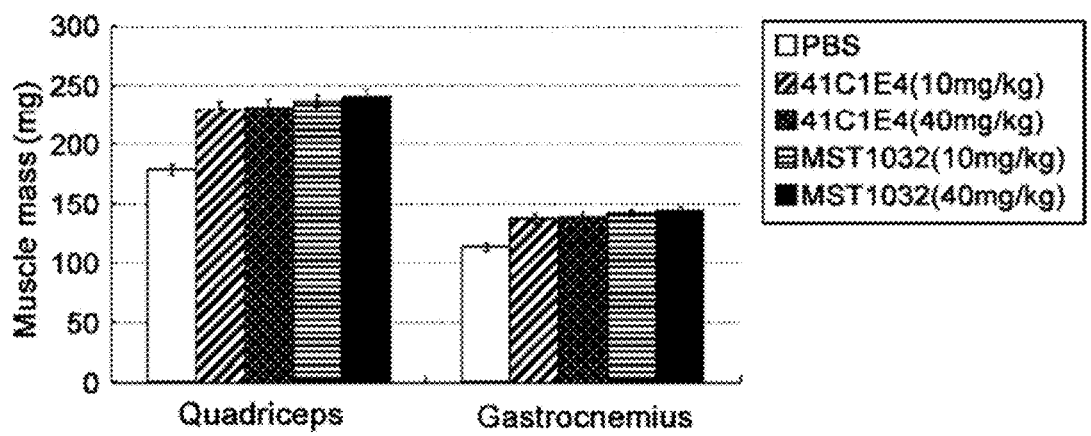

FIG. 6C illustrates in vivo efficacy of anti-latent myostatin antibody and anti-mature myostatin antibody on muscle mass and fat mass, as described in Example 8. Anti-latent myostatin antibody (MST1032-G1 m; described as MST1032 in the Figures) or anti-mature myostatin antibody (41C1E4) was administered to SCID mice, and gastrocnemius and quadriceps muscle mass was measured.

Figure 7A:
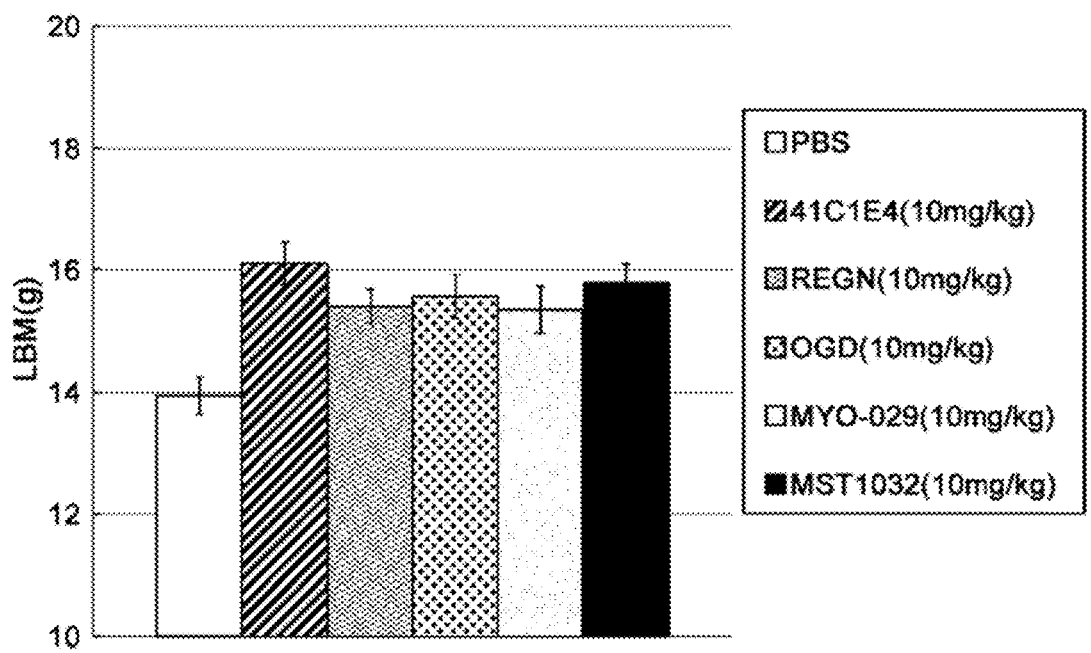

FIG. 7A illustrates comparison of in vivo efficacy among several anti-myostatin antibodies, as described in Example 9. Anti-latent myostatin antibody (MST1032-G1 m; described as MST1032 in the Figures) or anti-mature myostatin antibodies (41C1E4, REGN, OGD, and MYO-029) was administered to SCID mice, and full body lean mass was measured.

Figure 7B:
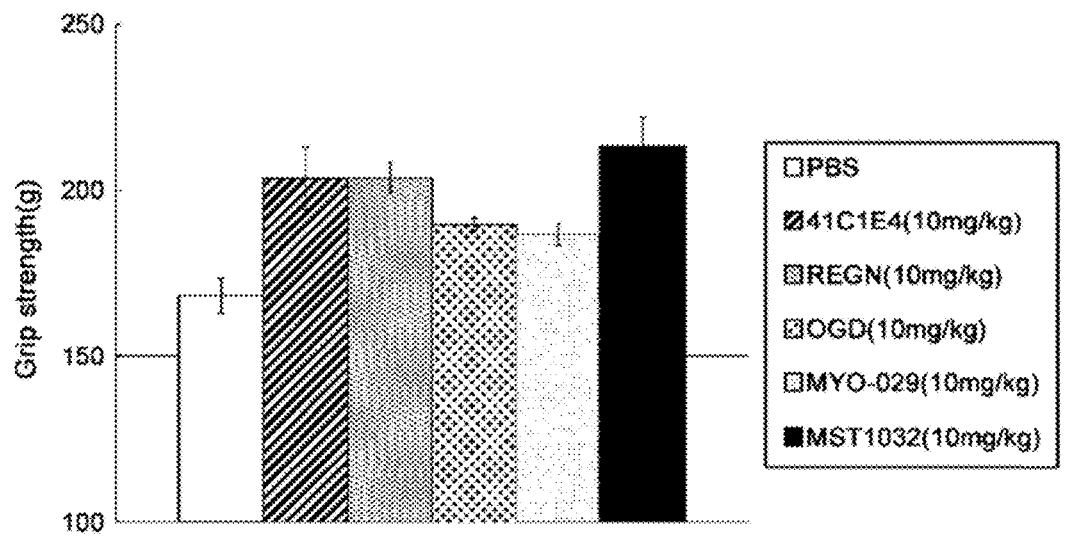

FIG. 7B illustrates comparison of in vivo efficacy among several anti-myostatin antibodies, as described in Example 9. Anti-latent myostatin antibody (MST1032-Glm; described as MST1032 in the Figures) or anti-mature myostatin antibodies (41C1E4, REGN, OGD, and MYO-029) was administered to SCID mice, and grip strength was measured.

Figure 7C:
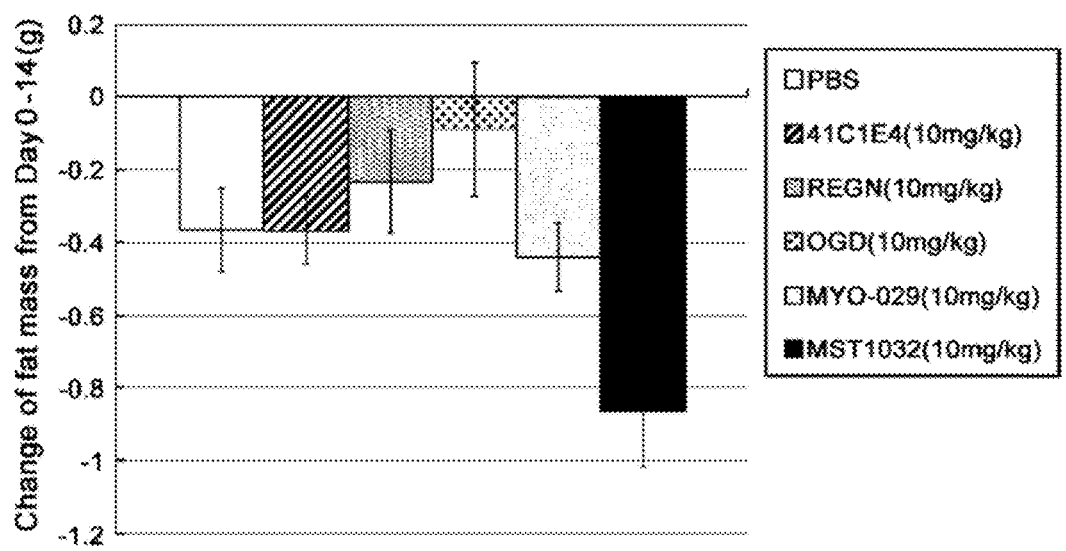

FIG. 7C illustrates comparison of in vivo efficacy among several anti-myostatin antibodies, as described in Example 9. Anti-latent myostatin antibody (MST1032-Glm; described as MST1032 in the Figures) or anti-mature myostatin antibodies (41C1E4, REGN, OGD, and MYO-029) was administered to SCID mice, and change of full body fat mass from Day 0 to Day 14 was measured.

Figure 8:
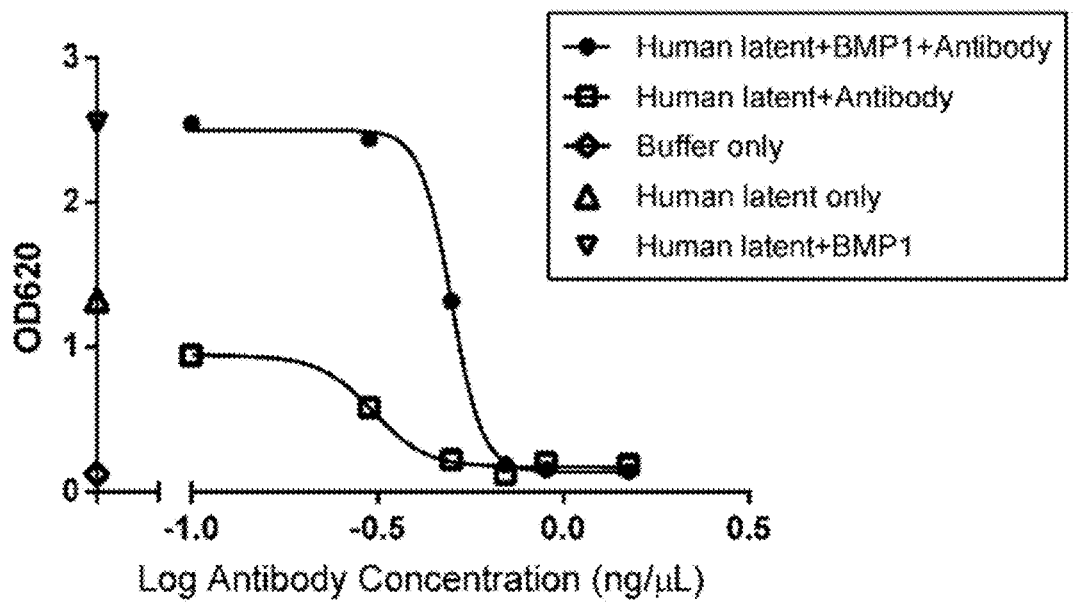

FIG. 8 illustrates inhibition of proteolytic and spontaneous activation of latent myostatin by humanized anti-latent myostatin antibody, as described in Example 10. The activity of active myostatin released from latent myostatin by BMP1 protease (proteolytic) or by 37° C. incubation without BMP1 (spontaneous) was measured in the presence of anti-latent myostatin antibody, using HEK Blue Assay.

Figure 9:
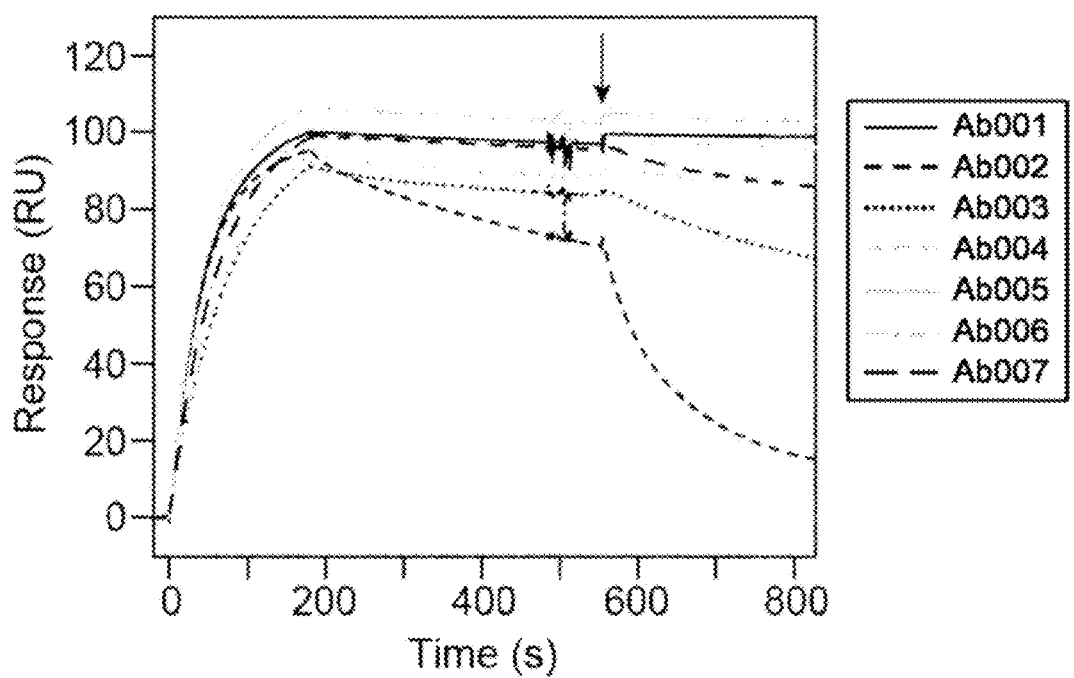
Figure 10B:
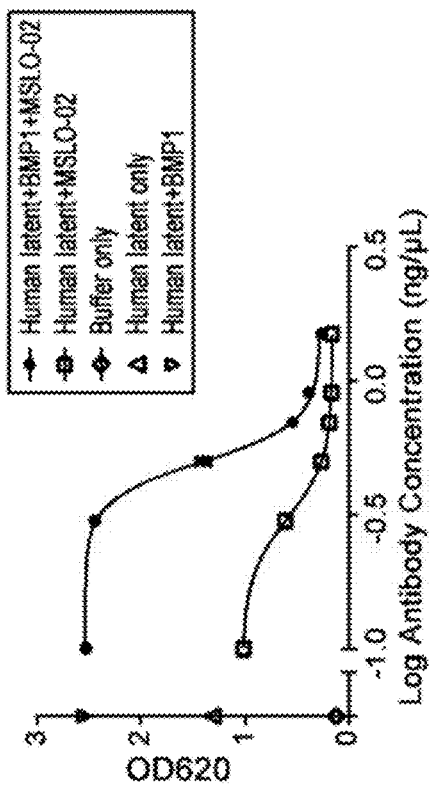
Figure 10D:
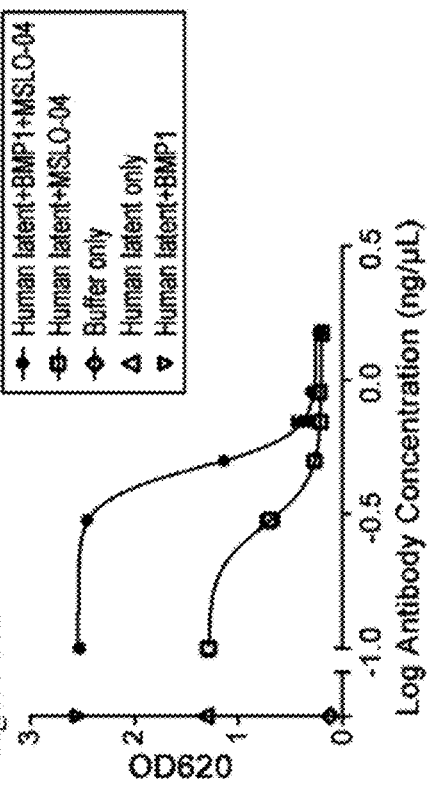
Figure 10A:
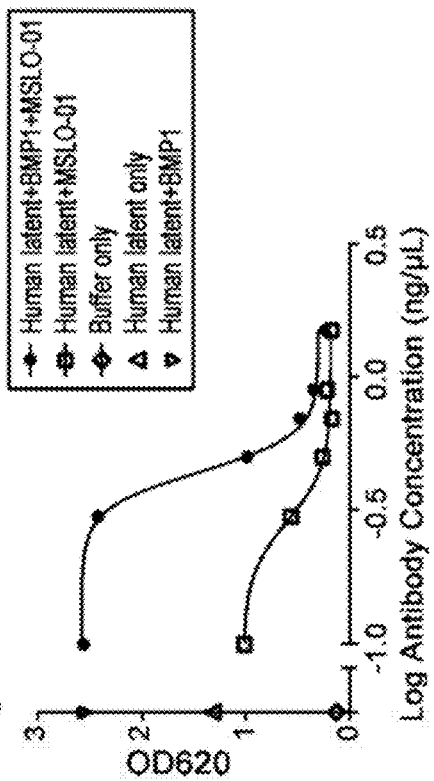
Figure 10C:
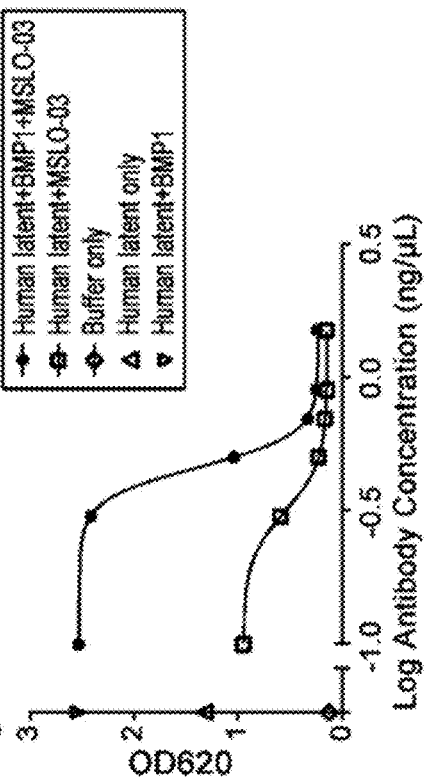

FIG. 9 illustrates BIACORE® sensorgrams of histidine substituted variants of anti-latent myostatin antibody, as described in Example 11. The antibody/antigen complexes were allowed to dissociate at pH7.4, followed by additional dissociation at pH5.8 (pointed by an arrow) to assess the pH-dependent interactions. Antibodies tested in this experiment are: Ab001 (black solid curve), Ab002 (black short-dashed curve), Ab003 (black dotted curve), Ab004 (gray short-dashed curve), Ab005 (gray solid curve), Ab006 (gray long-dashed curve), and Ab007 (black long-dashed curve).

FIGS. 10A-10D illustrate the inhibition of proteolytic and spontaneous activation of latent myostatin by pH-dependent anti-latent myostatin antibodies, as described in Example 13. The activity of active myostatin released from latent myostatin by BMP1 protease (proteolytic) or by 37° C. incubation without BMP1 (spontaneous) was measured in the presence of anti-latent myostatin antibodies, using HEK Blue Assay. Antibodies (A) MS1032LO01-SG1, (B) MS1032LO02-SG1, (C) MS1032LO03-SG1, and (D) MS1032LO04-SG1 are described, respectively, as MSLO-01, MSLO-02, MSLO-03, and MSLO-04 in the Figure. Comparable inhibition of proteolytic and spontaneous activation of latent myostatin to MS1032LO00-SG1 was achieved by MS1032LO01-SG1, MS1032LO02-SG1, MS1032LO03-SG1, and MS1032LO04-SG1.

FIGS. 11A-11F illustrate BIACORE® sensorgrams of pH-dependent anti-latent myostatin antibody, as described in Example 14. Kinetic parameters of MST1032-SG1 (A), MS1032LO00-SG1 (B), MS1032LO01-SG1 (C), MS1032LO02-SG1 (D), MS1032LO03-SG1 (E), and MS1032LO04-SG1 (F), were measured at neutral pH and acidic pH.

Figure 12:
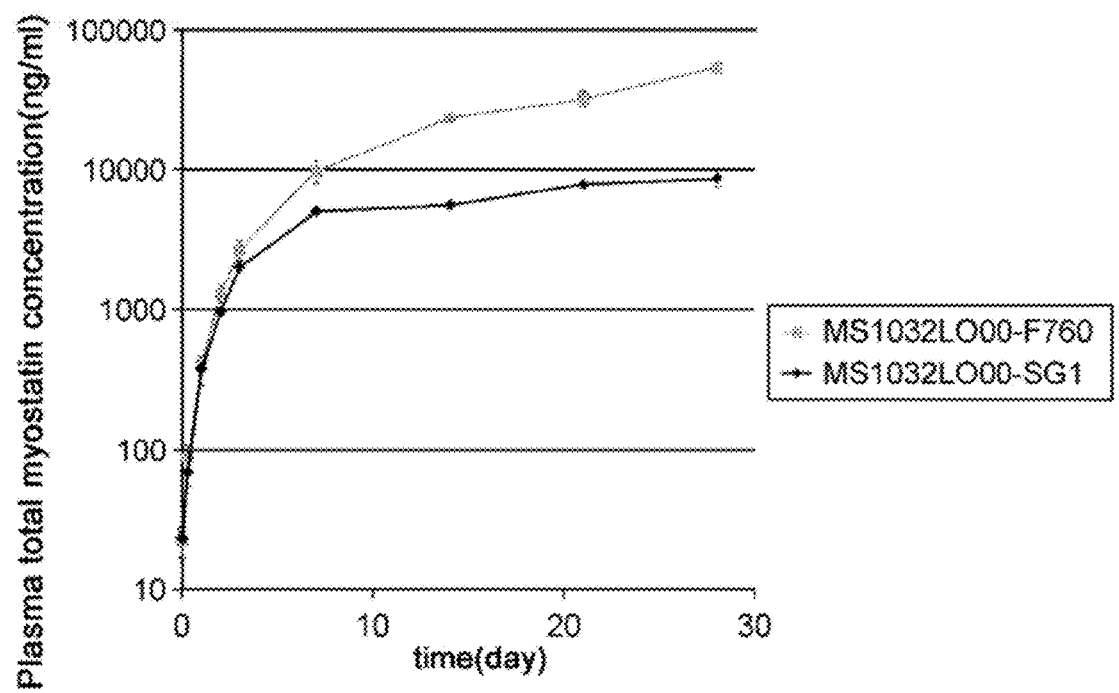
Figure 14A:
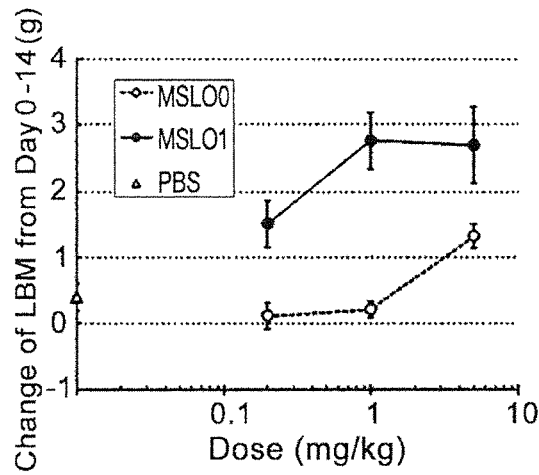
Figure 14B:
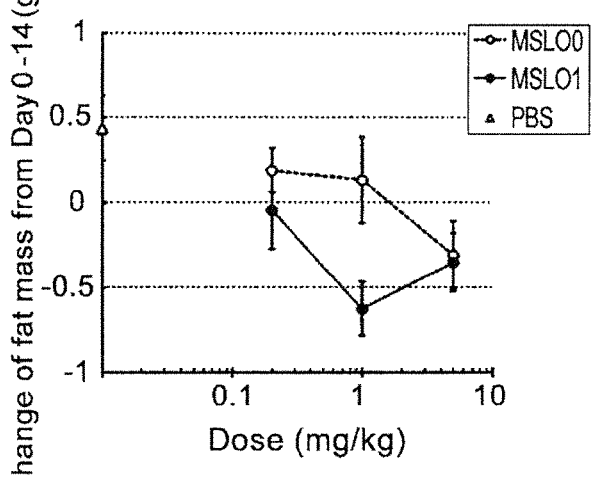
Figure 14C:
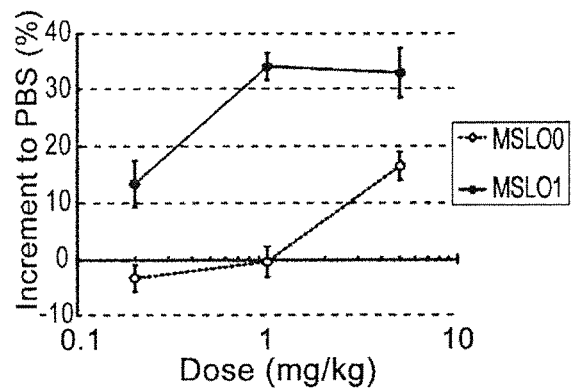
Figure 14D:
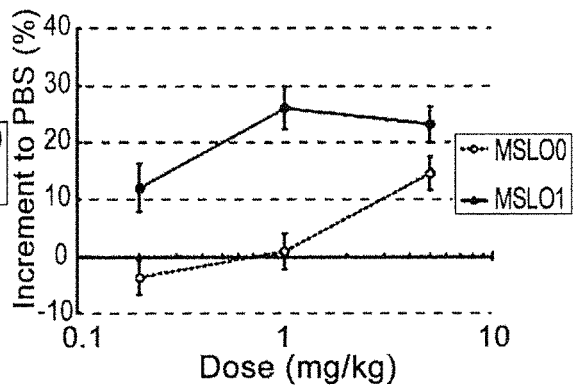
Figure 14E:
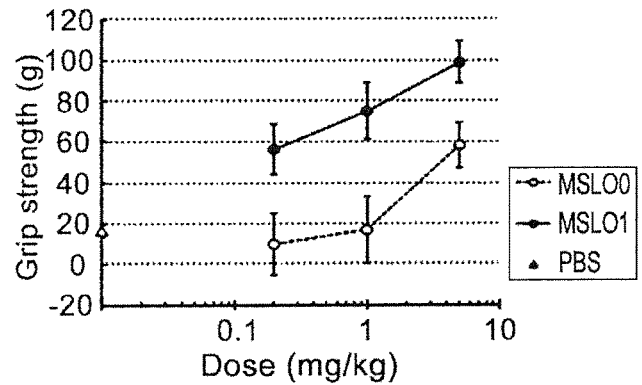

FIG. 12 illustrates the time course of plasma myostatin concentration after intravenous administration of an anti-myostatin antibody in mice, as described in Example 15. The effects of FcγR-mediated cellular uptake of antibody/antigen complexes on myostatin clearance in vivo was assessed by comparing anti-myostatin antibodies with FcγR binding (MS1032LO00-SG1) and anti-myostatin antibodies with abolished FcγR binding (MS1032LO00-F760).

FIG. 13 illustrates the time course of plasma myostatin concentration after intravenous administration of an anti-myostatin antibody in mice, as described in Example 16. The effects of pH-dependent binding of anti-myostatin antibody on myostatin clearance in vivo was assessed by comparing pH-dependent anti-myostatin antibody (MS1032LO01-SG1 or MS1032LO01-F760) and non pH-dependent anti-myostatin antibody (MS1032LO00-SG1 or MS1032LO00-F760).

FIGS. 14A-14E illustrate in vivo efficacy of pH-dependent and non pH-dependent anti-latent myostatin antibodies, as described in Example 17. pH-dependent anti-latent myostatin antibody (MS1032LO01-SG1; described as MSLO1 in the Figure) or non pH-dependent anti-latent myostatin antibody (MS1032LO00-SG1; described as MSLO0 in the Figure) was administered to SCID mice, and full body lean mass (A), full body fat mass (B), quadriceps muscle mass (C), gastrocnemius muscle mass (D), and grip strength (E) was measured.

Figure 15:
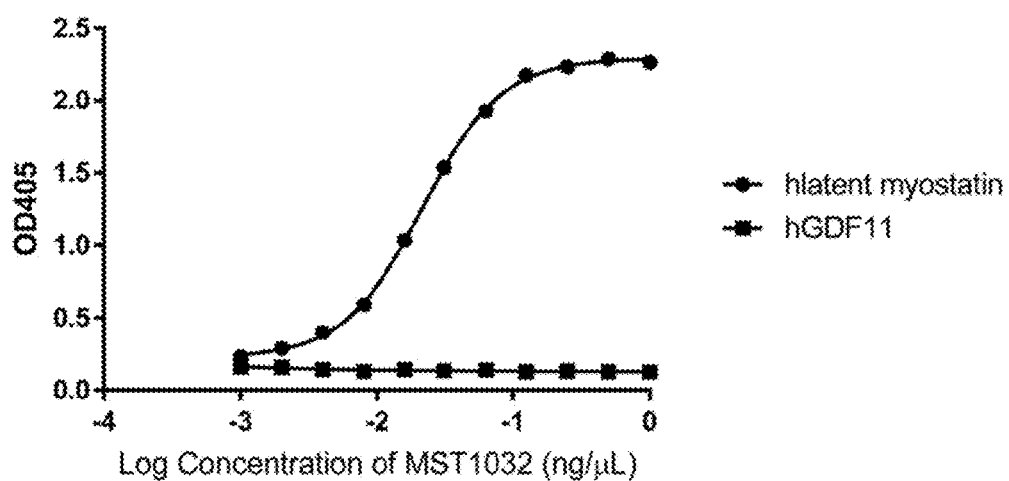

FIG. 15 illustrates binding activity of anti-latent myostatin antibody MST1032 to latent myostatin and GDF11, as described in Example 19.

Figure 16:
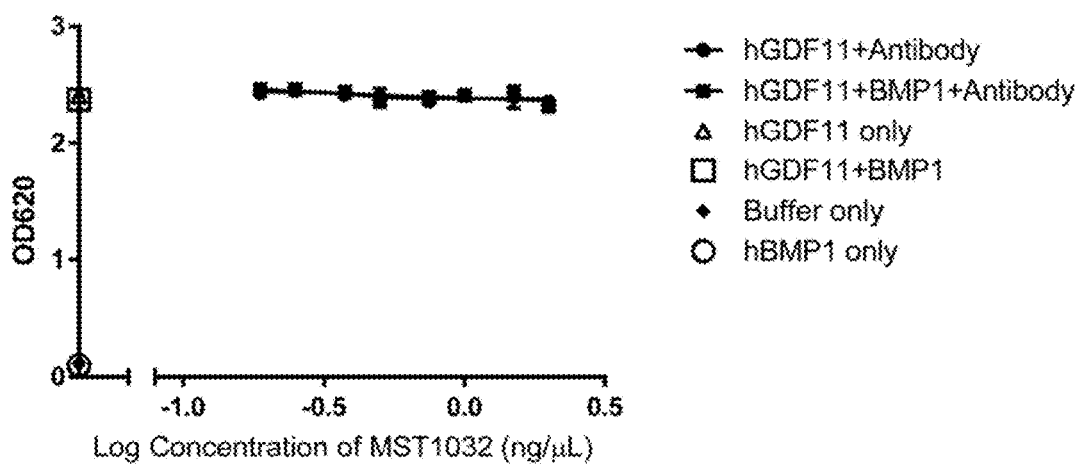

FIG. 16 illustrates the inhibitory activity of anti-latent myostatin antibody MST1032 against proteolytic and spontaneous activation of GDF11, as described in Example 20. The activity of active GDF11 released by BMP1 protease (proteolytic) or by 37° C. incubation without BMP1 (spontaneous) was measured in the presence of anti-latent myostatin antibody, using HEK Blue Assay.

Figure 17:
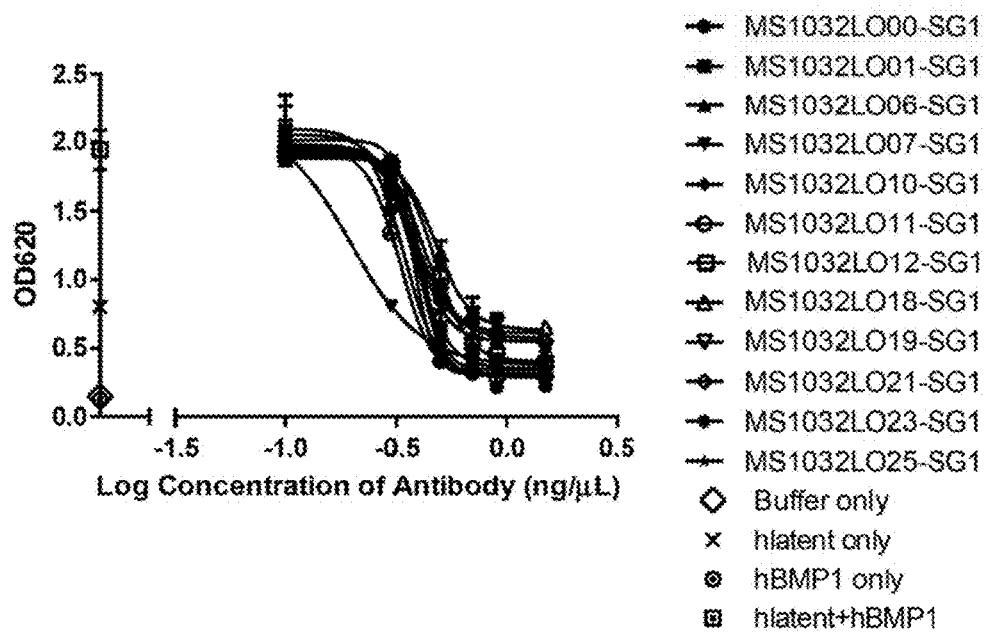

FIG. 17 illustrates inhibition of proteolytic activation of latent myostatin by anti-latent myostatin antibody, as described in Example 22. The activity of active myostatin released from latent myostatin by BMP1 protease was measured in the presence of anti-latent myostatin antibody, using HEK Blue Assay.

Figure 18:
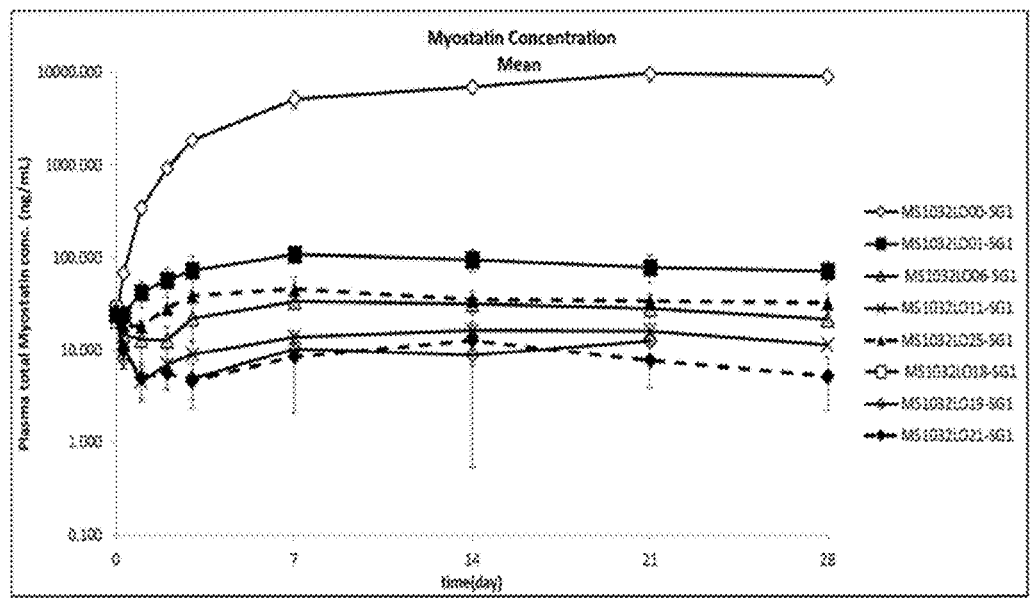
Figure 20A:
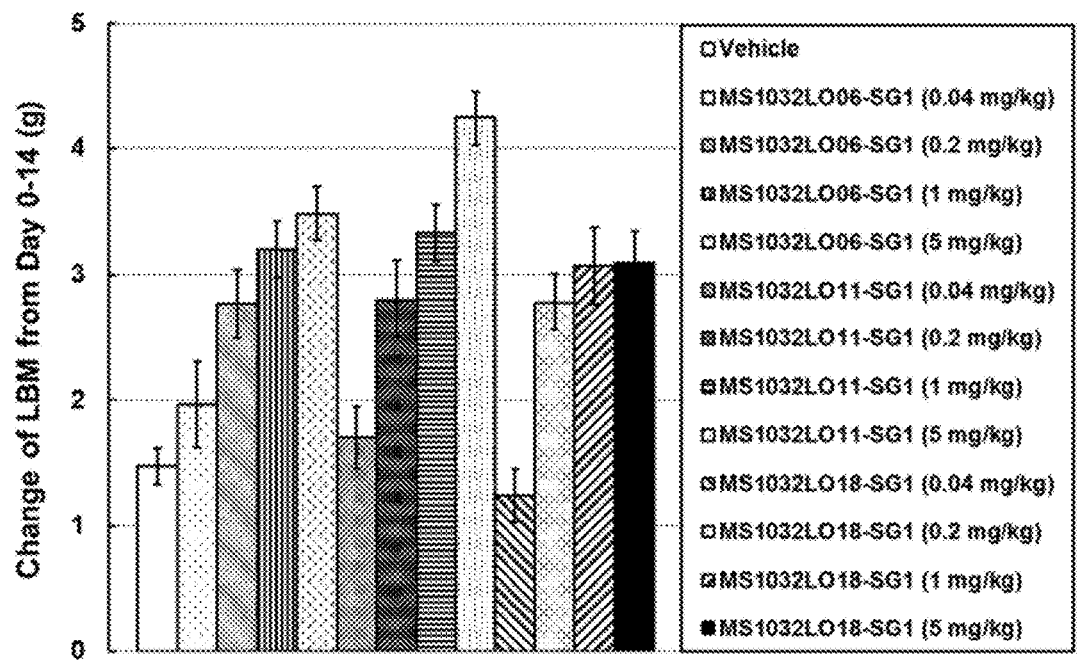
Figure 20B:
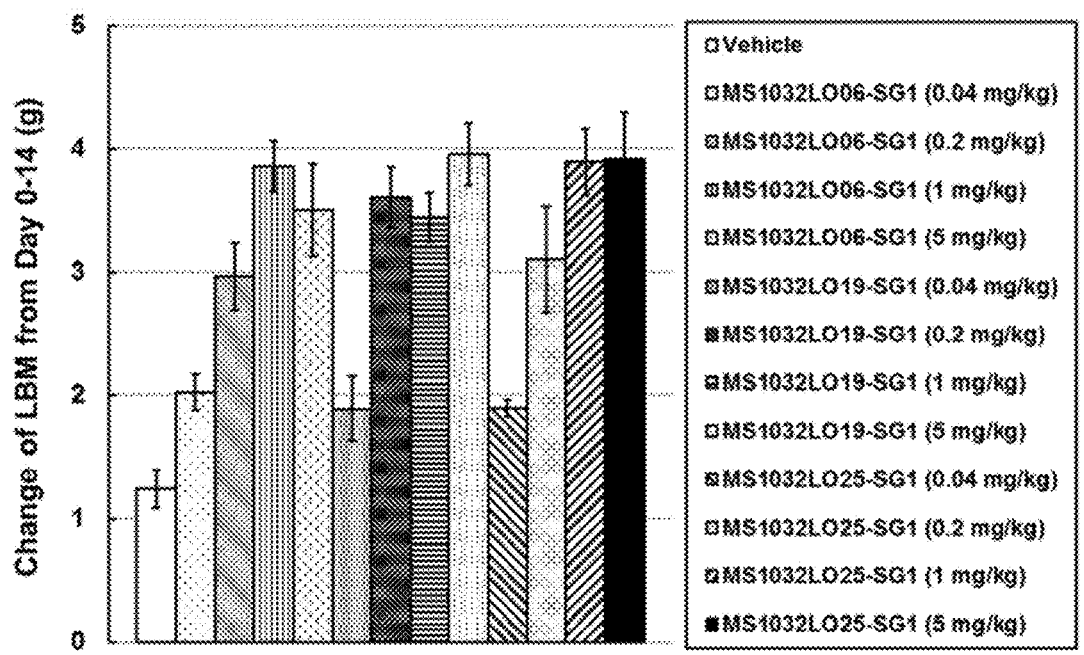
Figure 20C:
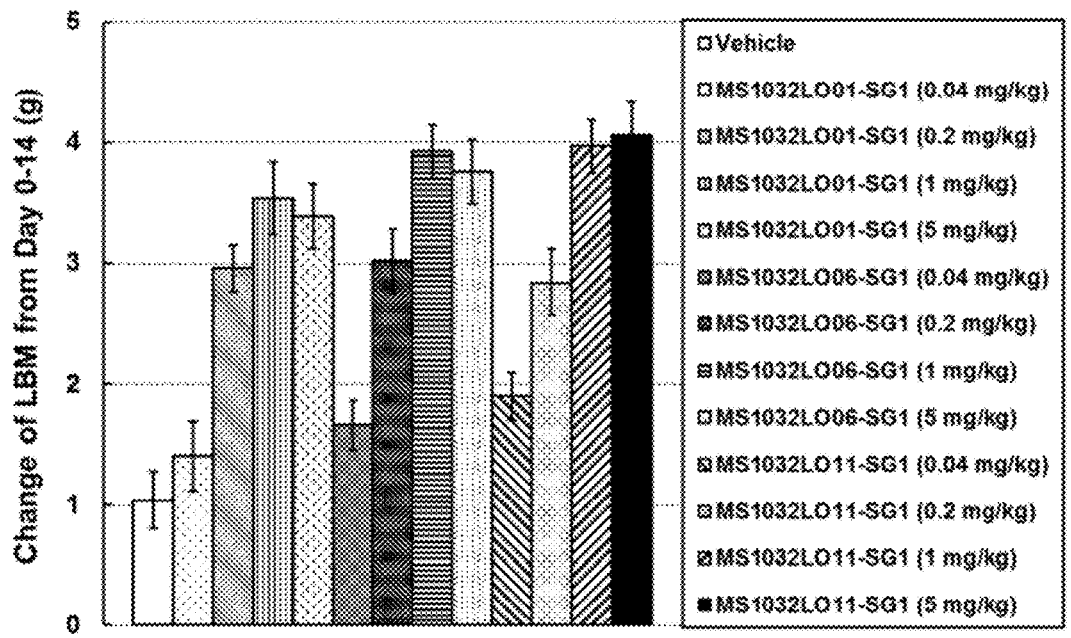
Figure 20D:
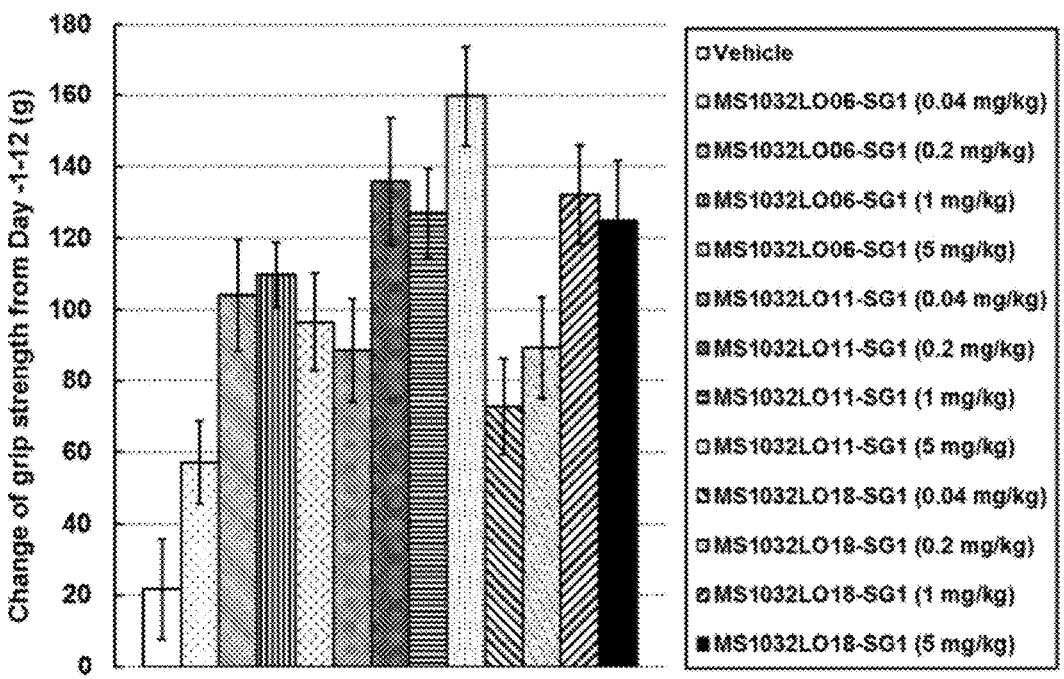
Figure 20E:
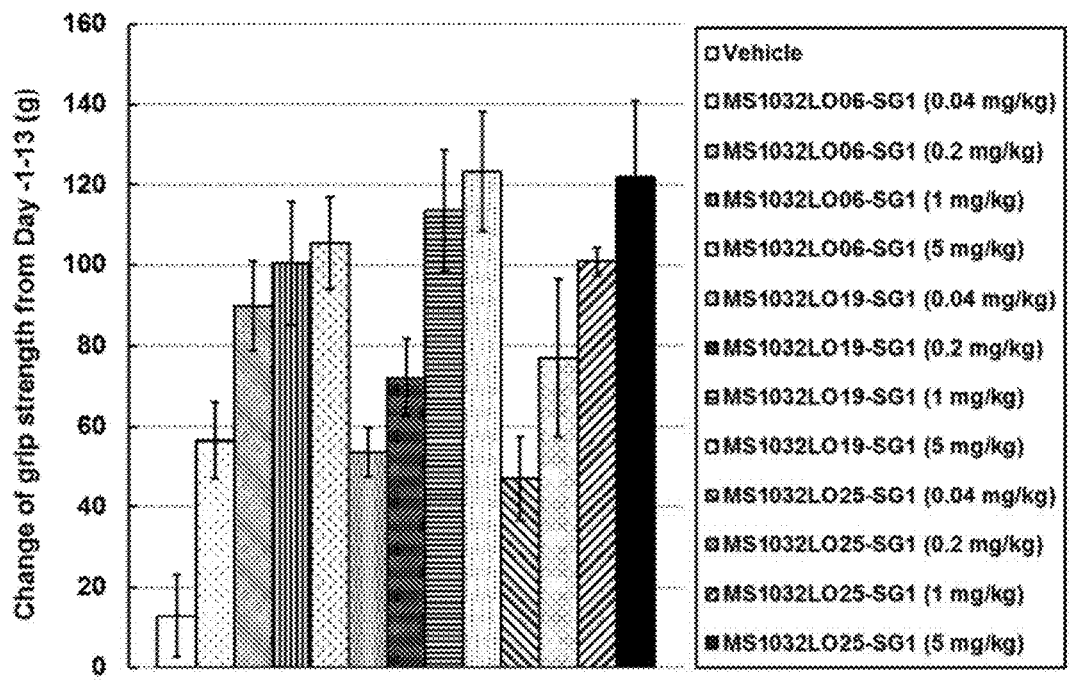
Figure 20F:
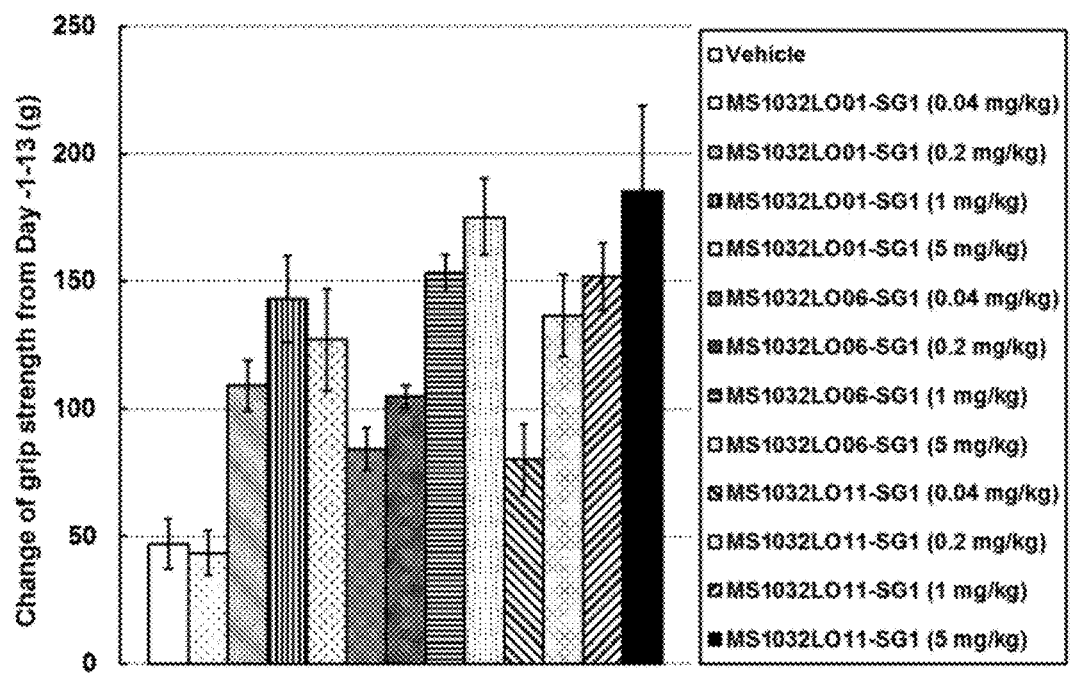
Figure 20G:
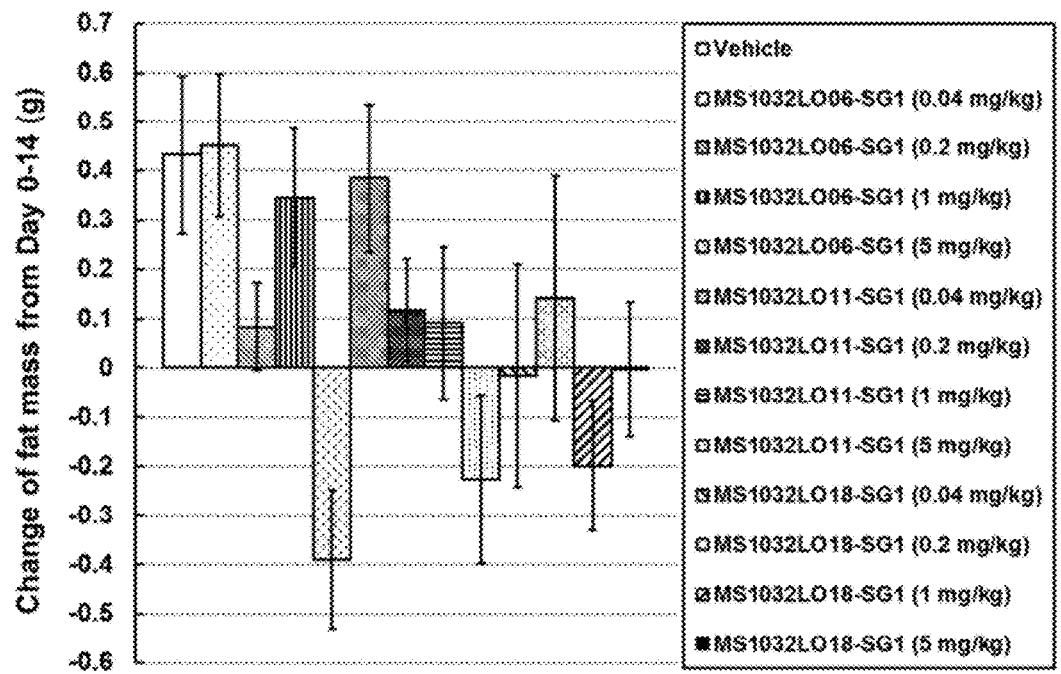
Figure 20H:
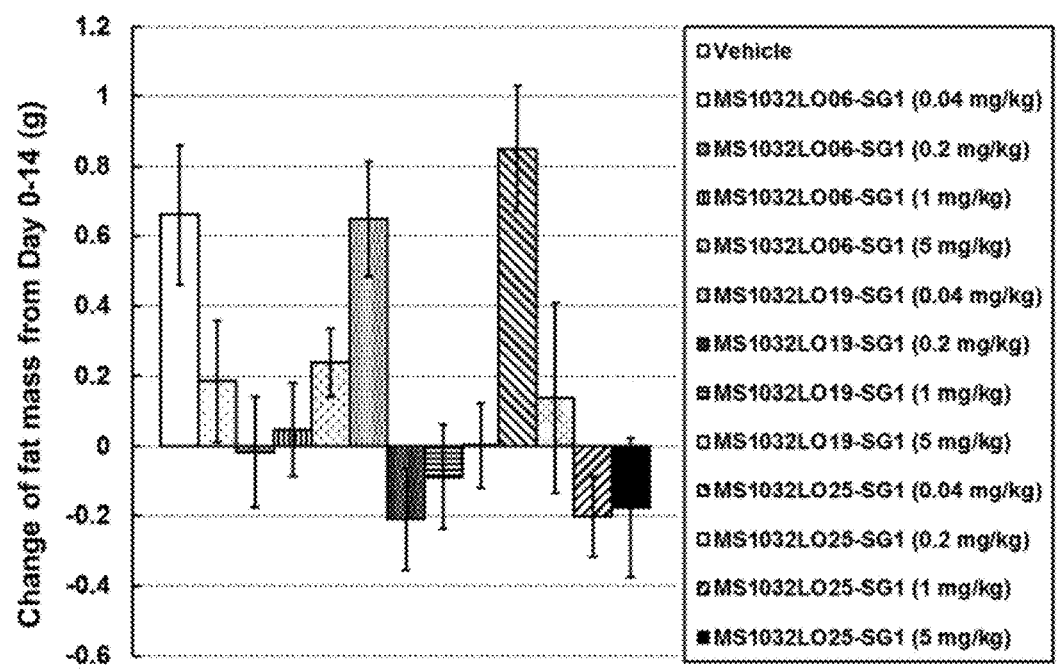
Figure 20I:
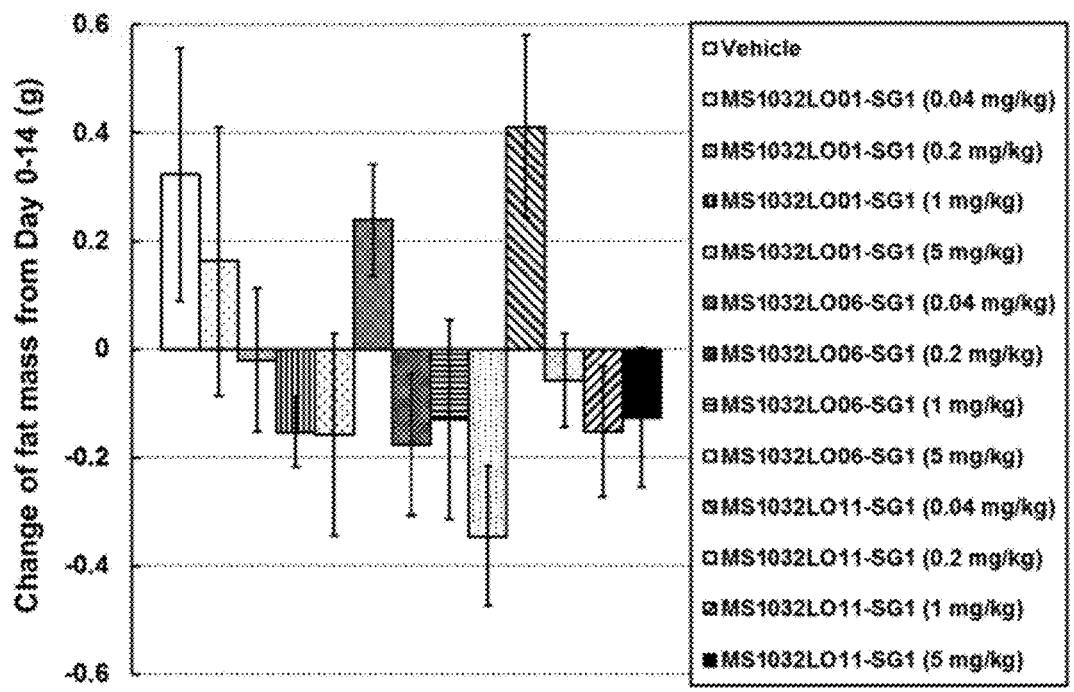

FIG. 18 illustrates the time course of plasma myostatin concentration after intravenous administration of anti-latent myostatin antibodies in mice, as described in Example 23. The effects of pH dependency on myostatin clearance in vivo was assessed by comparing non-pH dependent anti-latent myostatin antibody (MS1032LO00-SG1) and different pH-dependent anti-latent myostatin antibodies (MS1032LO01-SG1, MS1032LO06-SG1, MS1032LO11-SG1, MS1032LO18-SG1, MS1032LO19-SG1, MS1032LO21-SG1 and MS1032LO25-SG1).

FIGS. 19A and 19B illustrate the time course of plasma myostatin concentration after intravenous administration of anti-latent myostatin antibodies in cynomolgus monkey, as described in Example 24. (A) The effect of pH-dependency and Fc engineering on myostatin clearance in vivo was assessed by comparing non pH-dependent anti-latent myostatin antibody (MS1032LO00-SG1) and pH-dependent anti-latent myostatin antibodies with Fc engineering (MS1032LO06-SG1012, MS1032LO06-SG1016, MS1032LO06-SG1029, MS1032LO06-SG1031, MS1032LO06-SG1033, MS1032LO06-SG1034). (B) The effect of Fc engineering on myostatin clearance in vivo was assessed by comparing anti-latent myostatin antibodies (MS1032LO19-SG1079, MS1032LO19-SG1071, MS1032LO19-SG1080, MS1032LO19-SG1074, MS1032LO19-SG1081, and MS1032LO19-SG1077).

FIGS. 20A-20I illustrate in vivo efficacy of anti-latent myostatin antibodies (MS1032 variants) on lean body mass (LBM), grip strength, and body fat mass, as described in Example 25. MS1032LO06-SG1, MS1032LO11-SG1, and MS1032LO18-SG1 was administered to Scid mice, and lean body mass (A), grip strength (D), and body fat mass (G) were measured. MS1032LO06-SG1, MS1032LO19-SG1, and MS1032LO25-SG1 were administered to Scid mice, and lean body mass (B), grip strength (E), and body fat mass (H) were measured. MS1032LO01-SG1, MS1032LO06-SG1, and MS1032LO11-SG1 were administered to Scid mice, and lean body mass (C), grip strength (F), and body fat mass (I) were measured.

Figure 21:
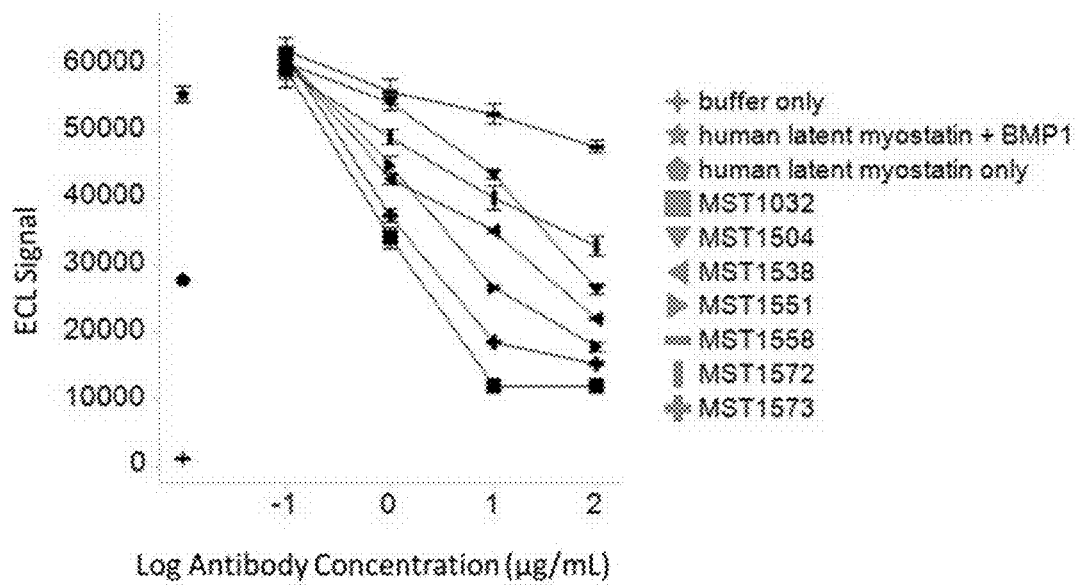

FIG. 21 illustrates inhibitory activity on latent myostatin activation by anti-latent myostatin antibodies, as described in Example 26. The amounts of mature myostatin released from latent myostatin by BMP1 protease were measured in the presence of anti-latent myostatin antibodies (MST1032, MST1504, MST1538, MST1551, MST1558, MST1572, and MST1573).

Figure 22A:
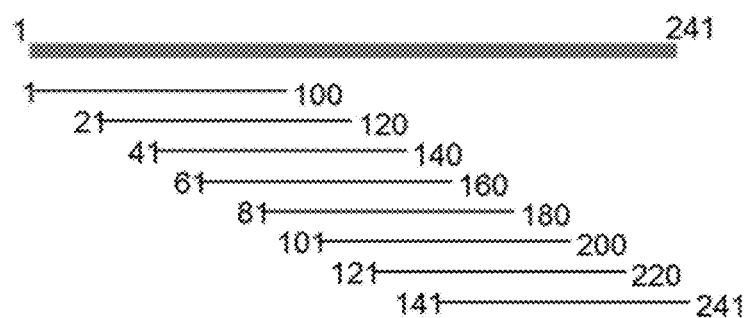

FIG. 22A illustrates a schematic diagram of latent myostatin fragments of 100 amino acid each, designed for epitope mapping of anti-latent myostatin antibodies, as described in Example 26.

Figure 22B:
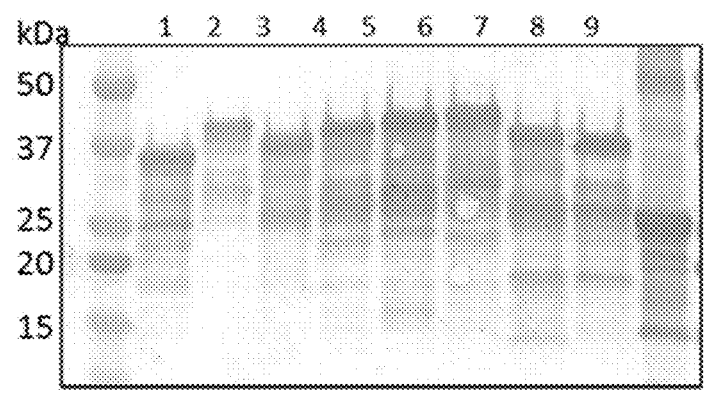

FIG. 22B illustrates Western blotting analysis against GST tagged human latent myostatin fragments (GST-hMSTN) by an anti-GST antibody, as described in Example 26. Each lane indicates: 1, GST-hMSTN 1-100aa; 2, GST-hMSTN 21-120aa; 3, GST-hMSTN 41-140aa; 4, GST-hMSTN 61-160aa; 5, GST-hMSTN 81-180aa; 6, GST-hMSTN 101-200aa; 7, GST-hMSTN 121-220aa; 8, GST-hMSTN 141-241aa; 9, GST control.

FIG. 22C illustrates Western blotting analysis against GST tagged human latent myostatin fragments (GST-hMSTN) by anti-latent myostatin antibodies (MST1032, MST1538, MST1572, and MST1573), as described in Example 26. Each lane indicates: 1, GST-hMSTN 1-100aa; 2, GST-hMSTN 21-120aa; 3, GST-hMSTN 41-140aa; 4, GST-hMSTN 61-160aa; 5, GST-hMSTN 81-180aa; 6, GST-hMSTN 101-200aa; 7, GST-hMSTN 121-220aa; 8, GST-hMSTN 141-241 aa; 9, GST control; 10, human latent myostatin (100 ng).

FIG. 22D illustrates summarized results of Western blotting analysis and deduced epitope positions for anti-latent myostatin antibodies (MST1032, MST1538, MST1572, and MST1573), as described in Example 26.

Figures 23, 24:
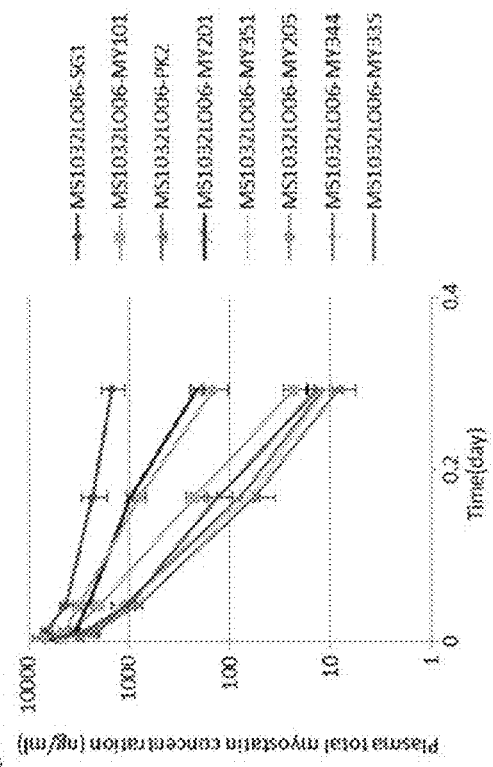

FIG. 23 illustrates an alignment of amino acid sequences of cynomolgus (cyno) FcγRIIa1, FcγRIIa2, FcγRIIa3, FcγRIIb, human FcγRIIaH, FcγRIIaR, and FcγRIIb. Squared regions indicate putative residues which interact with Fc domain.

FIG. 24 illustrates the time course of total myostatin concentration in plasma after intravenous administration of an anti-myostatin antibody with an FcγRIIb-enhanced Fc variant in all human FcγR transgenic mice, as described in Example 28. The effects of FcγRIIb-enhanced Fc variants on antigen elimination through human FcγRIIb were evaluated.

Figure 25:
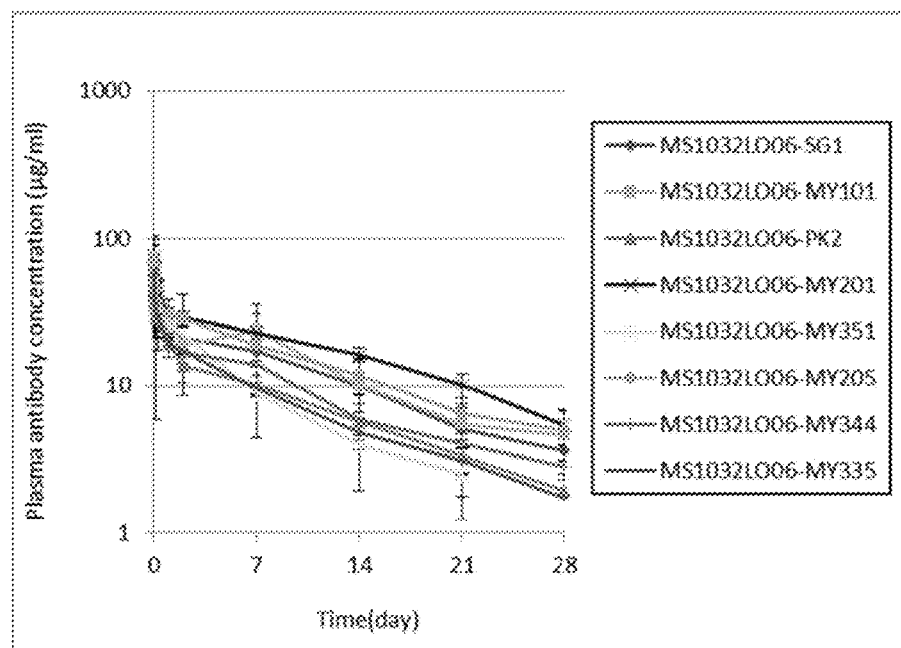

FIG. 25 illustrates the time course of antibody concentration in plasma after intravenous administration of an anti-myostatin antibody with an FcγRIIb-enhanced Fc variant in all human FcγR transgenic mice, as described in Example 28. The effects of FcγRIIb-enhanced Fc variants on antibody pharmacokinetics were evaluated.

Figure 26A:
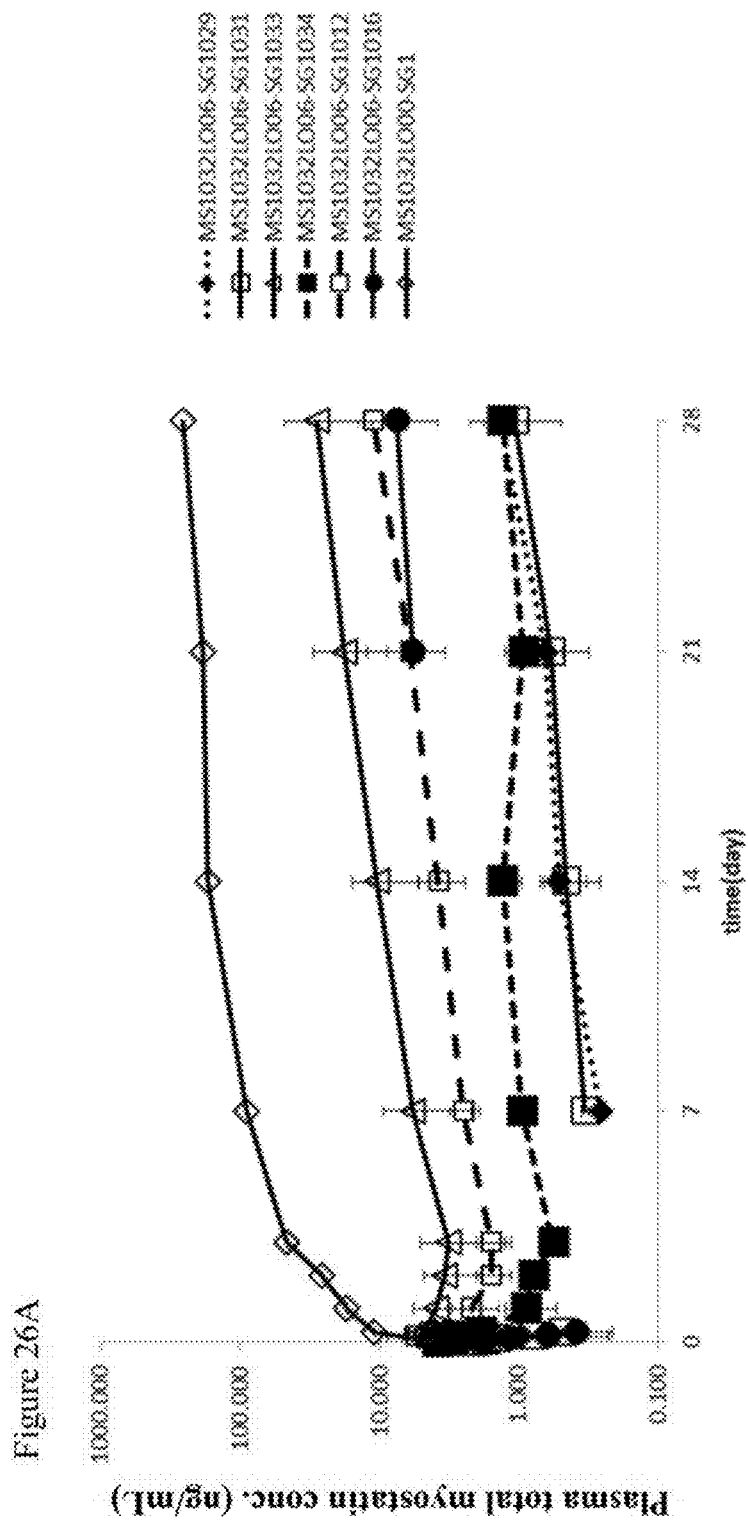

FIGS. 26A and 26B illustrate the time course of plasma myostatin concentration after intravenous administration of anti-latent myostatin antibodies in cynomolgus monkey, as described in Example 29. (A) The effect of pH-dependency and Fc engineering on myostatin clearance in vivo was assessed by comparing non pH-dependent anti-latent myostatin antibody (MS1032LO00-SG1) and pH-dependent anti-latent myostatin antibodies with Fc engineering (MS1032LO06-SG1012, MS1032LO06-SG1016, MS1032LO06-SG1029, MS1032LO06-SG1031, MS1032LO06-SG1033, MS1032LO06-SG1034). (B) The effect of Fc engineering on myostatin clearance in vivo was assessed by comparing anti-latent myostatin antibodies (MS1032LO19-SG1079, MS1032LO19-SG1071, MS1032LO19-SG1080, MS1032LO19-SG1074, MS1032LO19-SG1081, and MS1032LO19-SG1077).

Figure 27A:
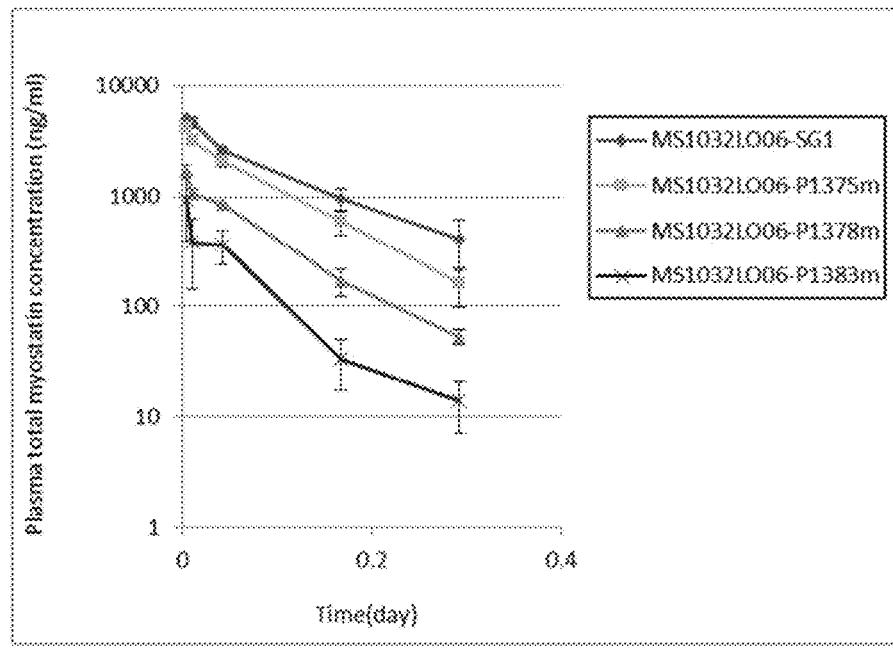

FIG. 27A illustrates the time course of total myostatin concentration in plasma after intravenous administration of an anti-myostatin antibody with a pI-increased Fc variant in human FcRn transgenic mice, as described in Example 30. The effects of pI-increased Fc variants on antigen elimination were evaluated.

Figure 27B:
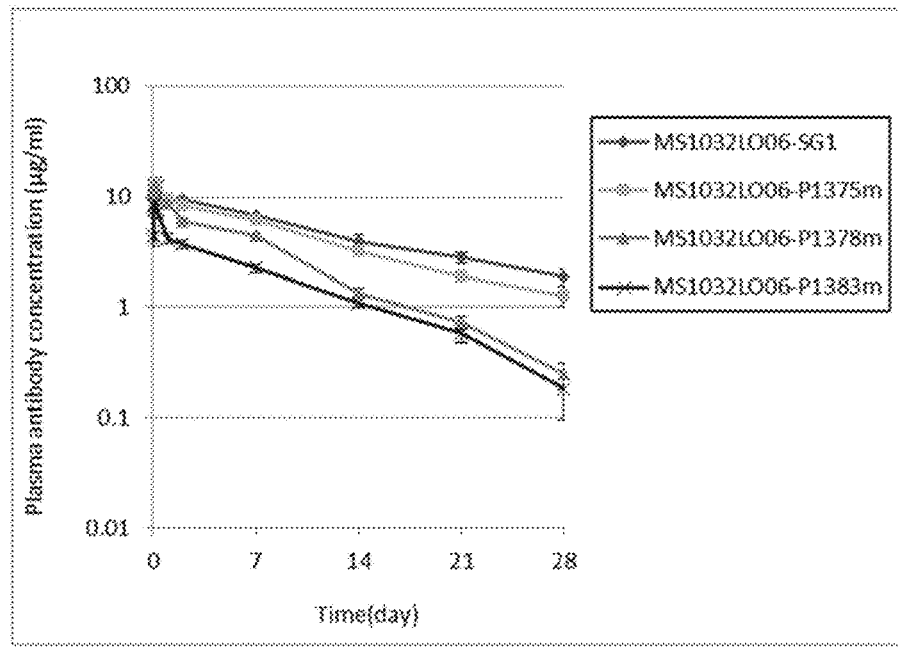

FIG. 27B illustrates the time course of antibody concentration in plasma after intravenous administration of an anti-myostatin antibody with a pI-increased Fc variant in human FcRn transgenic mice, as described in Example 30. The effects of pI-increased Fc variants on antibody pharmacokinetics were evaluated.

Figure 28A:
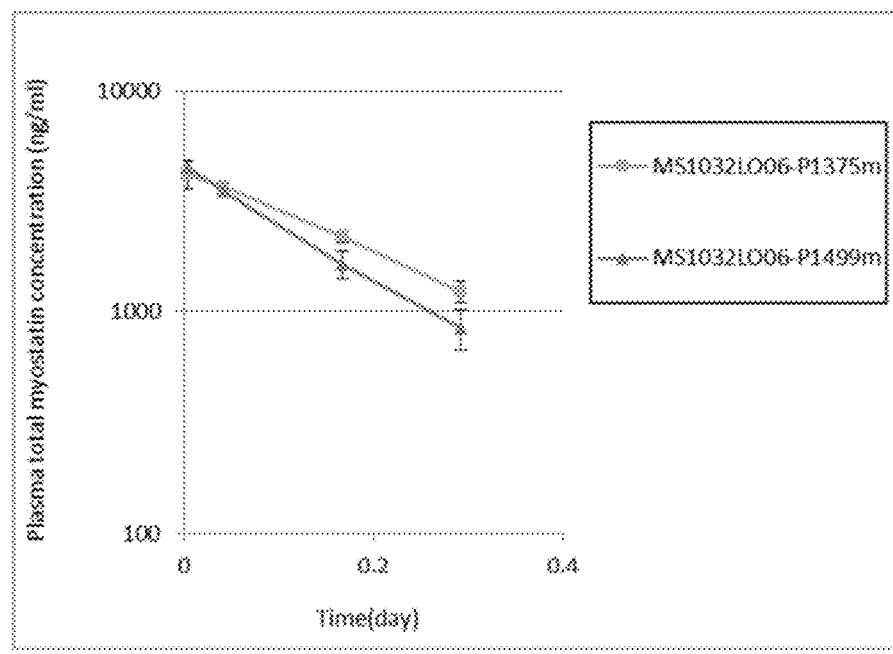

FIG. 28A illustrates the time course of total myostatin concentration in plasma after intravenous administration of an anti-myostatin antibody with a pI-increased Fc variant in human FcRn transgenic mice, as described in Example 30. The effects of pI-increased Fc variants on antigen elimination were evaluated. In this assay, an excess of human normal immunoglobin were co-administered with the anti-myostatin antibody in order to mimic the situation of human plasma.

Figure 28B:
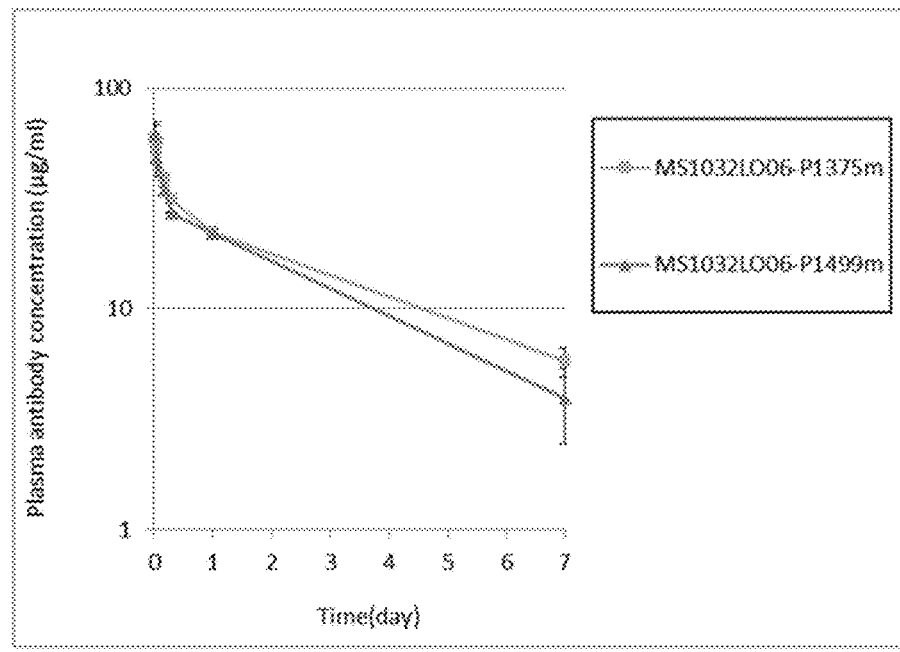

FIG. 28B illustrates the time course of antibody concentration in plasma after intravenous administration of an anti-myostatin antibody with a pI-increased Fc variant in human FcRn transgenic mice, as described in Example 30. The effects of pI-increased Fc variants on antibody pharmacokinetics were evaluated. In this assay, an excess of human normal immunoglobin were co-administered with the anti-myostatin antibody in order to mimic the situation of human plasma.

Figure 29:
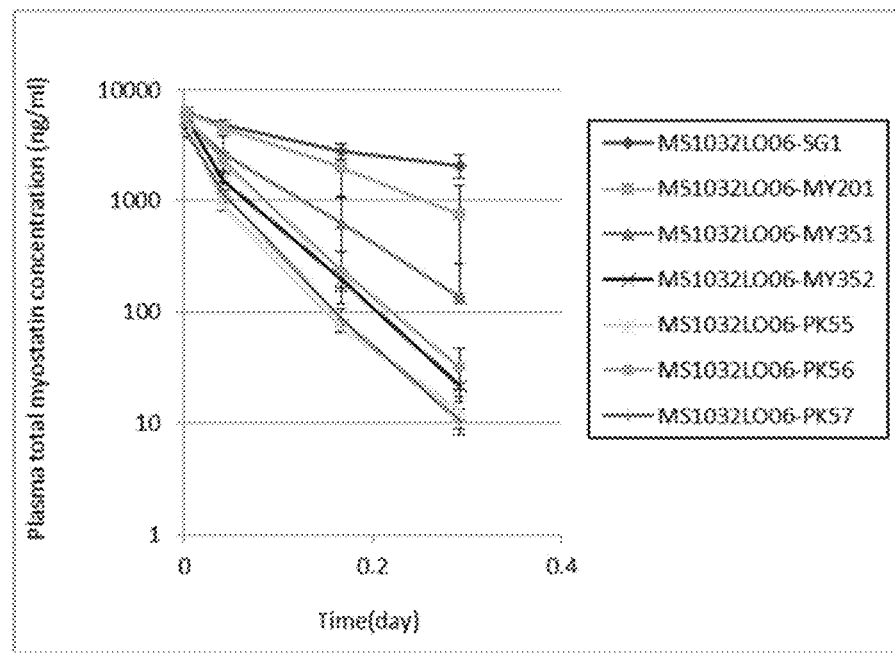

FIG. 29 illustrates the time course of total myostatin concentration in plasma after intravenous administration of an anti-myostatin antibody with an FcγRIIb-enhanced Fc variant in human FcγRIIb transgenic mice, as described in Example 31. The effects of FcγRIIb-enhanced Fc variants on antigen elimination through human FcγRIIb were evaluated.

Figure 30:
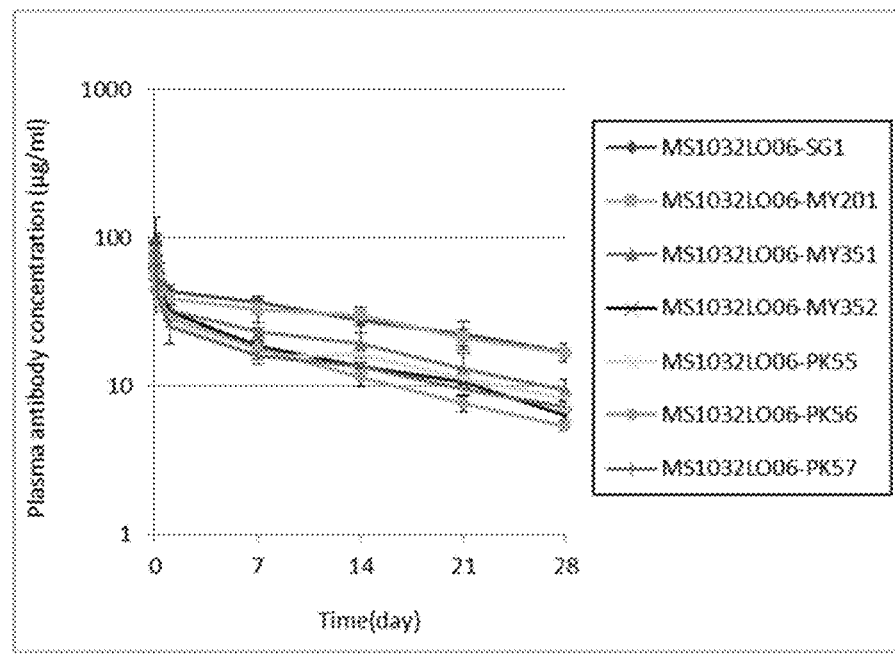

FIG. 30 illustrates the time course of antibody concentration in plasma after intravenous administration of an anti-myostatin antibody with an FcγRIIb-enhanced Fc variant in human FcγRIIb transgenic mice, as described in Example 31. The effects of FcγRIIb-enhanced Fc variants on antibody pharmacokinetics were evaluated.

Figure 31:
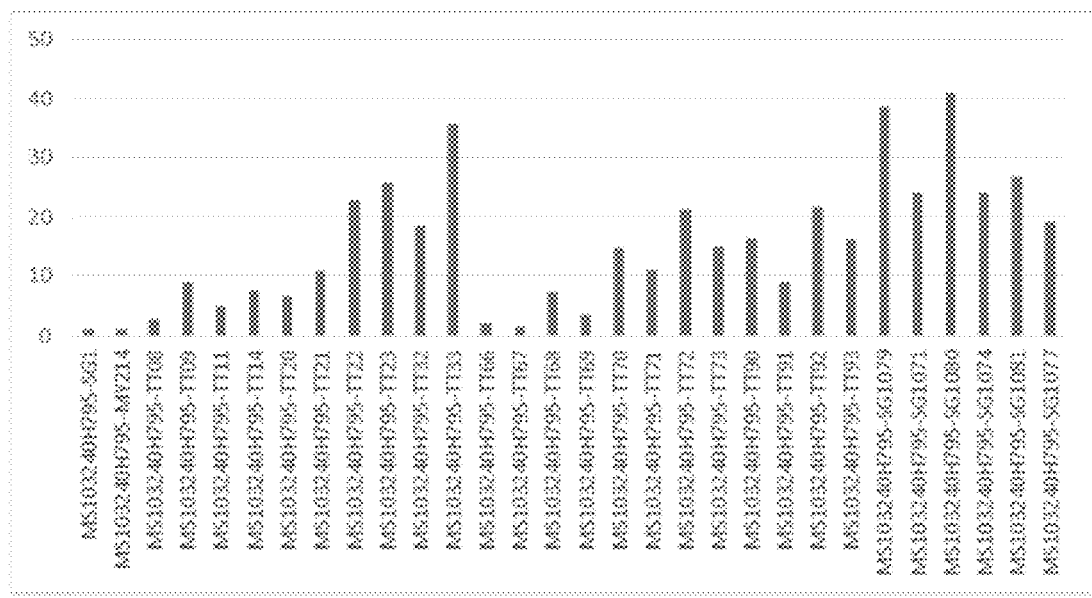

FIG. 31 illustrates results of cell imaging analysis of anti-myostatin antibodies with an FcγRIIb-enhanced Fc variant, as described in Example 33. Each antibody was complexed with fluorescence-labelled myostatin and intracellular uptake of the antigen-antibody complex into cells expressing human FcγRIIb was measured.

DETAILED DESCRIPTION

The techniques and procedures described or referenced herein are generally well understood and commonly employed using conventional methodology by those skilled in the art, such as, for example, the widely utilized methodologies described in Sambrook et al., Molecular Cloning: A Laboratory Manual 3d edition (2001) Cold Spring Harbor Laboratory Press, Cold Spring Harbor, N.Y.; Current Protocols in Molecular Biology (F. M. Ausubel, et al., eds., (2003)); the series Methods in Enzymology (Academic Press, Inc.): PCR 2: A Practical Approach (M. J. MacPherson, B. D. Hames and G. R. Taylor eds. (1995)), Harlow and Lane, eds. (1988) Antibodies, A Laboratory Manual, and Animal Cell Culture (R. I. Freshney, ed. (1987)); Oligonucleotide Synthesis (M. J. Gait, ed., 1984); Methods in Molecular Biology, Humana Press; Cell Biology: A Laboratory Notebook (J. E. Cellis, ed., 1998) Academic Press; Animal Cell Culture (R. I. Freshney, ed., 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds., 1993-8) J. Wiley and Sons; Handbook of Experimental Immunology (D. M. Weir and C. C. Blackwell, eds.); Gene Transfer Vectors for Mammalian Cells (J. M. Miller and M. P. Calos, eds., 1987); PCR: The Polymerase Chain Reaction, (Mullis et al., eds., 1994); Current Protocols in Immunology (J. E. Coligan et al., eds., 1991); Short Protocols in Molecular Biology (Wiley and Sons, 1999); Immunobiology (C. A. Janeway and P. Travers, 1997); Antibodies (P. Finch, 1997); Antibodies: A Practical Approach (D. Catty., ed., IRL Press, 1988-1989); Monoclonal Antibodies: A Practical Approach (P. Shepherd and C. Dean, eds., Oxford University Press, 2000); Using Antibodies: A Laboratory Manual (E. Harlow and D. Lane, Cold Spring Harbor Laboratory Press, 1999); The Antibodies (M. Zanetti and J. D. Capra, eds., Harwood Academic Publishers, 1995); and Cancer: Principles and Practice of Oncology (V. T. DeVita et al., eds., J. B. Lippincott Company, 1993).

I. Definitions

Unless defined otherwise, technical and scientific terms used herein have the same meaning as commonly understood by one of ordinary skill in the art to which this invention belongs. Singleton et al., Dictionary of Microbiology and Molecular Biology 2nd ed., J. Wiley & Sons (New York, N.Y. 1994), and March, Advanced Organic Chemistry Reactions, Mechanisms and Structure 4th ed., John Wiley & Sons (New York, N.Y. 1992), provide one skilled in the art with a general guide to many of the terms used in the present application. All references cited herein, including patent applications and publications, are incorporated by reference in their entirety. In particular, the disclosure of Japanese Pat. Appl. 2014-257636, filed Dec. 19, 2014, is herein incorporated by reference in its entirety.

For purposes of interpreting this specification, the following definitions will apply and whenever appropriate, terms used in the singular will also include the plural and vice versa. It is to be understood that the terminology used herein is for the purpose of describing particular embodiments only, and is not intended to be limiting. In the event that any definition set forth below conflicts with any document incorporated herein by reference, the definition set forth below shall control.

An "acceptor human framework" for the purposes herein is a framework comprising the amino acid sequence of a light chain variable domain (VL) framework or a heavy chain variable domain (VH) framework derived from a human immunoglobulin framework or a human consensus framework, as defined below. An acceptor human framework "derived from" a human immunoglobulin framework or a human consensus framework may comprise the same amino acid sequence thereof, or it may contain amino acid sequence changes. In some embodiments, the number of amino acid changes are 10 or less, 9 or less, 8 or less, 7 or less, 6 or less, 5 or less, 4 or less, 3 or less, or 2 or less. In some embodiments, the VL acceptor human framework is identical in sequence to the VL human immunoglobulin framework sequence or human consensus framework sequence.

"Affinity" refers to the strength of the sum total of noncovalent interactions between a single binding site of a molecule (e.g., an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X for its partner Y can generally be represented by the dissociation constant (Kd). Affinity can be measured by common methods known in the art, including those described herein. Specific illustrative and exemplary embodiments for measuring binding affinity are described in the following.

An "affinity matured" antibody refers to an antibody with one or more alterations in one or more hypervariable regions (HVRs), compared to a parent antibody which does not possess such alterations, such alterations resulting in an improvement in the affinity of the antibody for antigen.

The terms "anti-myostatin antibody" and "an antibody that binds to myostatin" refer to an antibody that is capable of binding myostatin with sufficient affinity such that the antibody is useful as a diagnostic and/or therapeutic agent in targeting myostatin. In one embodiment, the extent of binding of an anti-myostatin antibody to an unrelated, non-myostatin protein is less than about 10% of the binding of the antibody to myostatin as measured, e.g., by a radioimmunoassay (RIA). In certain embodiments, an antibody that binds to myostatin has a dissociation constant (Kd) of ≤1 μM, ≤100 nM, ≤10 nM, ≤1 nM, ≤0.1 nM, ≤0.01 nM, or ≤0.001 nM (e.g., $10^{-8}$ M or less, e.g., from $10^{-8}$ M to $10^{-13}$ M, e.g., from $10^{-9}$ M to $10^{-13}$ M). In certain embodiments, an anti myostatin antibody binds to an epitope of myostatin that is conserved among myostatin from different species.

The term "antibody" herein is used in the broadest sense and encompasses various antibody structures, including but not limited to monoclonal antibodies, polyclonal antibodies, multispecific antibodies (e.g., bispecific antibodies), and antibody fragments so long as they exhibit the desired antigen-binding activity.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')$_2$; diabodies; linear antibodies; single-chain antibody molecules (e.g., scFv); and multispecific antibodies formed from antibody fragments.

An "antibody that binds to the same epitope" as a reference antibody refers to an antibody that blocks binding of the reference antibody to its antigen in a competition assay, and/or conversely, the reference antibody blocks binding of the antibody to its antigen in a competition assay. An exemplary competition assay is provided herein.

The term "chimeric" antibody refers to an antibody in which a portion of the heavy and/or light chain is derived from a particular source or species, while the remainder of the heavy and/or light chain is derived from a different source or species.

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g., IgG$_1$, IgG$_2$, IgG$_3$, IgG$_4$, IgA$_1$, and IgA$_2$. The heavy chain constant domains that correspond to the different classes of immunoglobulins are called α, δ, ε, γ, and μ, respectively.

The term "cytotoxic agent" as used herein refers to a substance that inhibits or prevents a cellular function and/or causes cell death or destruction. Cytotoxic agents include, but are not limited to, radioactive isotopes (e.g., At$^{211}$, I$^{131}$, I$^{125}$, Y$^{90}$, Re$^{186}$, Re$^{188}$, Sm$^{153}$, Bi$^{212}$, P$^{32}$, Pb$^{212}$ and radioactive isotopes of Lu); chemotherapeutic agents or drugs (e.g., methotrexate, adriamycin, vinca alkaloids (vincristine, vinblastine, etoposide), doxorubicin, melphalan, mitomycin C, chlorambucil, daunorubicin or other intercalating agents); growth inhibitory agents; enzymes and fragments thereof such as nucleolytic enzymes; antibiotics; toxins such as small molecule toxins or enzymatically active toxins of bacterial, fungal, plant or animal origin, including fragments and/or variants thereof; and the various antitumor or anticancer agents disclosed below.

"Effector functions" refer to those biological activities attributable to the Fc region of an antibody, which vary with the antibody isotype. Examples of antibody effector functions include: C1q binding and complement dependent cytotoxicity (CDC); Fc receptor binding; antibody-dependent cell-mediated cytotoxicity (ADCC); phagocytosis; down regulation of cell surface receptors (e.g., B cell receptor); and B cell activation.

An "effective amount" of an agent, e.g., a pharmaceutical formulation, refers to an amount effective, at dosages and for periods of time necessary, to achieve the desired therapeutic or prophylactic result.

The term "epitope" includes any determinant capable of being bound by an antibody. An epitope is a region of an antigen that is bound by an antibody that targets that antigen, and includes specific amino acids that directly contact the antibody. Epitope determinants can include chemically active surface groupings of molecules such as amino acids, sugar side chains, phosphoryl or sulfonyl groups, and can have specific three dimensional structural characteristics, and/or specific charge characteristics. Generally, antibodies specific for a particular target antigen will preferentially recognize an epitope on the target antigen in a complex mixture of proteins and/or macromolecules.

"Fc receptor" or "FcR" describes a receptor that binds to the Fc region of an antibody. In some embodiments, an FcR is a native human FcR. In some embodiments, an FcR is one which binds an IgG antibody (a gamma receptor) and includes receptors of the FcγRI, FcγRII, and FcγRIII subclasses, including allelic variants and alternatively spliced forms of those receptors. FcγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain. (See, e.g., Daëron, *Annu. Rev. Immunol.* 15:203-234 (1997).) FcRs are reviewed, for example, in Ravetch and Kinet, *Annu. Rev. Immunol.* 9:457-92 (1991); Capel et al., *Immunomethods* 4:25-34 (1994); and de Haas et al., *J. Lab. Clin. Med.* 126:330-41 (1995). Other FcRs, including those to be identified in the future, are encompassed by the term "FcR" herein.

The term "Fc receptor" or "FcR" also includes the neonatal receptor, FcRn, which is responsible for the transfer of maternal IgGs to the fetus (Guyer et al., *J. Immunol.* 117:587 (1976) and Kim et al., *J. Immunol.* 24:249 (1994)) and regulation of homeostasis of immunoglobulins. Methods of measuring binding to FcRn are known (see, e.g., Ghetie and Ward., *Immunol. Today* 18(12):592-598 (1997); Ghetie et al., *Nature Biotechnology* 15(7):637-640 (1997); Hinton et al., *J. Biol. Chem.* 279(8):6213-6216 (2004); WO 2004/92219 (Hinton et al.). Binding to human FcRn in vivo and serum half life of human FcRn high affinity binding polypeptides can be assayed, e.g., in transgenic mice or transfected human cell lines expressing human FcRn, or in primates to which the polypeptides with a variant Fc region are administered. WO 2000/42072 (Presta) describes antibody variants with improved or diminished binding to FcRs. See also, e.g., Shields et al., *J. Biol. Chem.* 9(2):6591-6604 (2001).

The term "Fc region" herein is used to define a C-terminal region of an immunoglobulin heavy chain that contains at least a portion of the constant region. The term includes native sequence Fc regions and variant Fc regions. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., *Sequences of Proteins of Immunological Interest*, 5th Ed. Public Health Service, National Institutes of Health, Bethesda, Md., 1991.

The term "Fc region-comprising antibody" refers to an antibody that comprises an Fc region. The C-terminal lysine (residue 447 according to the EU numbering system) of the Fc region may be removed, for example, during purification of the antibody or by recombinant engineering of the nucleic acid encoding the antibody. Accordingly, a composition comprising an antibody having an Fc region according to this invention can comprise an antibody with K447, with all K447 removed, or a mixture of antibodies with and without the K447 residue.

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1(L1)-FR2-H2(L2)-FR3-H3(L3)-FR4.

The terms "full length antibody," "intact antibody," and "whole antibody" are used herein interchangeably to refer to an antibody having a structure substantially similar to a native antibody structure or having heavy chains that contain an Fc region as defined herein.

A "functional Fc region" possesses an "effector function" of a native sequence Fc region. Exemplary "effector functions" include C1q binding; CDC; Fc receptor binding; ADCC; phagocytosis; down regulation of cell surface receptors (e.g., B cell receptor; BCR), etc. Such effector functions generally require the Fc region to be combined with a binding domain (e.g., an antibody variable domain) and can be assessed using various assays as disclosed, for example, in definitions herein.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

A "human antibody" is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

A "human consensus framework" is a framework which represents the most commonly occurring amino acid residues in a selection of human immunoglobulin VL or VH framework sequences. Generally, the selection of human immunoglobulin VL or VH sequences is from a subgroup of variable domain sequences. Generally, the subgroup of sequences is a subgroup as in Kabat et al., *Sequences of Proteins of Immunological Interest*, Fifth Edition, NIH Publication 91-3242, Bethesda Md. (1991), vols. 1-3, which is herein incorporated by reference in its entirety. In one embodiment, for the VL, the subgroup is subgroup kappa I as in Kabat et al., supra. In one embodiment, for the VH, the subgroup is subgroup III as in Kabat et al., supra.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization.

The term "hypervariable region" or "HVR" as used herein refers to each of the regions of an antibody variable domain which are hypervariable in sequence ("complementarity determining regions" or "CDRs") and/or form structurally defined loops ("hypervariable loops") and/or contain the antigen-contacting residues ("antigen contacts"). Generally, antibodies comprise six HVRs: three in the VH (H1, H2, H3), and three in the VL (L1, L2, L3). Exemplary HVRs herein include: (a) hypervariable loops occurring at amino acid residues 26-32 (L1), 50-52 (L2), 91-96 (L3), 26-32 (H1), 53-55 (H2), and 96-101 (H3) (Chothia and Lesk, *J. Mol. Biol.* 196:901-917 (1987)); (b) CDRs occurring at amino acid residues 24-34 (L1), 50-56 (L2), 89-97 (L3), 31-35b (H1), 50-65 (H2), and 95-102 (H3) (Kabat et al., *Sequences of Proteins of Immunological Interest*, 5th Ed. Public Health Service, NIH, Bethesda, Md. (1991)); (c) antigen contacts occurring at amino acid residues 27c-36 (L1), 46-55 (L2), 89-96 (L3), 30-35b (H1), 47-58 (H2), and 93-101 (H3) (MacCallum et al., *J. Mol. Biol.* 262: 732-745 (1996)); and (d) combinations of (a), (b), and/or (c), including HVR amino acid residues 46-56 (L2), 47-56 (L2), 48-56 (L2), 49-56 (L2), 26-35 (H1), 26-35b (H1), 49-65 (H2), 93-102 (H3), and 94-102 (H3).

Unless otherwise indicated, HVR residues and other residues in the variable domain (e.g., FR residues) are numbered herein according to Kabat et al., supra.

An "immunoconjugate" is an antibody conjugated to one or more heterologous molecule(s), including but not limited to a cytotoxic agent.

An "individual" or "subject" is a mammal. Mammals include, but are not limited to, domesticated animals (e.g., cows, sheep, cats, dogs, and horses), primates (e.g., humans and non-human primates such as monkeys), rabbits, and rodents (e.g., mice and rats). In certain embodiments, the individual or subject is a human.

An "isolated" antibody is one which has been separated from a component of its natural environment. In some embodiments, an antibody is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of antibody purity, see, e.g., Flatman et al., *J. Chrornatogr. B* 848:79-87 (2007).

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

"Isolated nucleic acid encoding an anti-myostatin antibody" refers to one or more nucleic acid molecules encoding antibody heavy and light chains (or fragments thereof), including such nucleic acid molecule(s) in a single vector or separate vectors, and such nucleic acid molecule(s) present at one or more locations in a host cell.

The term "monoclonal antibody" as used herein refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including but not limited to the hybridoma method, recombinant DNA methods, phage-display methods, and methods utilizing transgenic animals containing all or part of the human immunoglobulin loci, such methods and other exemplary methods for making monoclonal antibodies being described herein.

A "naked antibody" refers to an antibody that is not conjugated to a heterologous moiety (e.g., a cytotoxic moiety) or radiolabel. The naked antibody may be present in a pharmaceutical formulation.

"Native antibodies" refer to naturally occurring immunoglobulin molecules with varying structures. For example, native IgG antibodies are heterotetrameric glycoproteins of about 150,000 daltons, composed of two identical light chains and two identical heavy chains that are disulfide-bonded. From N- to C-terminus, each heavy chain has a variable region (VH), also called a variable heavy domain or a heavy chain variable domain, followed by three constant domains (CH1, CH2, and CH3). Similarly, from N- to C-terminus, each light chain has a variable region (VL), also called a variable light domain or a light chain variable domain, followed by a constant light (CL) domain. The light chain of an antibody may be assigned to one of two types, called kappa (κ) and lambda (λ), based on the amino acid sequence of its constant domain.

A "native sequence Fc region" comprises an amino acid sequence identical to the amino acid sequence of an Fc region found in nature. Native sequence human Fc regions include a native sequence human IgG1 Fc region (non-A and A allotypes); native sequence human IgG2 Fc region; native sequence human IgG3 Fc region; and native sequence human IgG4 Fc region as well as naturally occurring variants thereof.

The term "package insert" is used to refer to instructions customarily included in commercial packages of therapeutic products, that contain information about the indications, usage, dosage, administration, combination therapy, contraindications and/or warnings concerning the use of such therapeutic products.

"Percent (%) amino acid sequence identity" with respect to a reference polypeptide sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared. For purposes herein, however, % amino acid sequence identity values are generated using the sequence comparison computer program ALIGN-2. The ALIGN-2 sequence comparison computer program was authored by Genentech, Inc., and the source code has been filed with user documentation in the US Copyright Office, Washington D.C., 20559, where it is registered under US Copyright Registration No. TXU510087. The ALIGN-2 program is publicly available from Genentech, Inc., South San Francisco, Calif., or may be compiled from the source code. The ALIGN-2 program should be compiled for use on a UNIX operating system, including digital UNIX V4.0D. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows: 100 times the fraction X/Y; where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

The term "pharmaceutical formulation" refers to a preparation which is in such form as to permit the biological activity of an active ingredient contained therein to be effective, and which contains no additional components which are unacceptably toxic to a subject to which the formulation would be administered.

A "pharmaceutically acceptable carrier" refers to an ingredient in a pharmaceutical formulation, other than an active ingredient, which is nontoxic to a subject. A pharmaceutically acceptable carrier includes, but is not limited to, a buffer, excipient, stabilizer, or preservative.

The term "myostatin", as used herein, may refer to any native myostatin from any vertebrate source, including mammals such as primates (e.g., humans) and rodents (e.g., mice and rats). Unless otherwise indicated, the term "myostatin" refers to a human myostatin protein having the amino acid sequence shown in SEQ ID NO: 1 and containing the terminal propeptide domain of human myostatin as shown in SEQ ID NO: 75 or 78. The term encompasses "full-length", unprocessed myostatin as well as any form of myostatin that results from processing in the cell. The term also encompasses naturally occurring variants of myostatin, e.g., splice variants or allelic variants. The amino acid sequence of an exemplary human myostatin (promyostatin) is shown in SEQ ID NO: 1. The amino acid sequence of an exemplary C-terminal growth factor domain of human myostatin is shown in SEQ ID NO: 2. The amino acid sequence of an exemplary N-terminal propeptide domain of human myostatin is shown in SEQ ID NO: 75 or 78. Active mature myostatin is a disulfide-bonded homodimer consisting of two C-terminal growth factor domains. Inactive latent myostatin is a noncovalently-associated complex of two propeptides and the mature myostatin. As disclosed herein, the antibodies of the invention bind inactive latent myostatin, but do not bind the mature active myostatin homodimer. In some embodiments, the antibodies of the invention bind an epitope within a fragment consisting of amino acids 21-100 of myostatin propeptide (SEQ ID NO:78), but do not bind the mature active myostatin homodimer. The amino acid sequence of an exemplary cynomolgus monkey and murine myostatin (promyostatin) are shown in SEQ ID NO: 3 and 5, respectively. The amino acid sequence of an exemplary C-terminal growth factor domain of cynomolgus monkey and murine myostatin are shown in SEQ ID NO: 4 and 6, respectively. The amino acid sequence of an exemplary N-terminal propeptide domain of cynomolgus monkey and murine myostatin are shown in SEQ ID NO: 76 or 79, and 77 or 80, respectively. GDF-11 (BMP-11) is a closely related molecule to myostatin, both of which are members of TGF-β superfamily. Similarly to myostatin, GDF11 is synthesized as a precursor polypeptide first, and then cleaved into an N-terminal prodomain and C-terminal mature GDF11. The amino acid sequence of human GDF11 (precursor) is shown in SEQ ID NO: 81. The amino acid sequence of C-terminal mature human GDF11 is shown in SEQ ID NO: 82. The amino acid sequence of an N-terminal prodomain of human GDF11 is shown in SEQ ID NO: 83 or 84. Amino acid sequences of SEQ ID NOs: 1, 3, 5, 78, 79, 80, 81, and 84, include a signal sequence. Amino acids 1-24 of these sequences correspond to the signal sequence that is removed during processing in the cell.

As used herein, "treatment" (and grammatical variations thereof such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, antibodies of the invention are used to delay development of a disease or to slow the progression of a disease.

The term "variable region" or "variable domain" refers to the domain of an antibody heavy or light chain that is involved in binding the antibody to antigen. The variable domains of the heavy chain and light chain (VH and VL, respectively) of a native antibody generally have similar structures, with each domain comprising four conserved framework regions (FRs) and three hypervariable regions (HVRs). (See, e.g., Kindt et al., Kuby Immunology, 6$^{th}$ ed., W.H. Freeman and Co., page 91 (2007).) A single VH or VL domain may be sufficient to confer antigen-binding specificity. Furthermore, antibodies that bind a particular antigen may be isolated using a VH or VL domain from an antibody that binds the antigen to screen a library of complementary VL or VH domains, respectively. See, e.g., Portolano et al., J. Immunol. 150:880-887 (1993); Clarkson et al., Nature 352:624-628 (1991).

A "variant Fc region" comprises an amino acid sequence which differs from that of a native sequence Fc region by virtue of at least one amino acid modification (alteration), preferably one or more amino acid substitution(s). Preferably, the variant Fc region has at least one amino acid substitution compared to a native sequence Fc region or to the Fc region of a parent polypeptide, e.g., from about one to about ten amino acid substitutions, and preferably from about one to about five amino acid substitutions in a native sequence Fc region or in the Fc region of the parent polypeptide. The variant Fc region herein will preferably possess at least about 80% homology with a native sequence Fc region and/or with an Fc region of a parent polypeptide, and most preferably at least about 90% homology therewith, more preferably at least about 95% homology therewith.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors".

II. Compositions and Methods

In one aspect, the invention is based, in part, on anti-myostatin antibodies and uses thereof. In certain embodiments, antibodies that bind to myostatin are provided. Antibodies of the invention are useful, e.g., for the diagnosis or treatment of a muscle wasting disease.

In another aspect, the invention is based, in part, on polypeptides comprising variant Fc regions and uses thereof. In one embodiment, polypeptides comprising variant Fc regions with enhanced FcγRIIb-binding activity are provided. In another embodiment, polypeptides comprising variant Fc regions with increased pI are provided. In particular embodiments, the polypeptides of the invention are antibodies. Polypeptides comprising a variant Fc region of the invention are useful, e.g., for the diagnosis or treatment of diseases.

A. Exemplary Anti-Myostatin Antibodies and Polypeptides Comprising Variant Fc Regions In one aspect, the invention provides isolated antibodies that bind to myostatin. In certain embodiments, an anti-myostatin antibody of the present invention binds to latent myostatin. In further embodiments, an anti-myostatin antibody of the present invention binds to the myostatin propeptide (human: SEQ ID NO: 75 or 78; cynomolgus monkey: SEQ ID NO: 76 or 79; mouse: SEQ ID NO: 77 or 80). In further embodiments, the antibody binds to an epitope within a fragment consisting of amino acids 21-100 of myostatin propeptide (SEQ ID NO: 78). Propeptide is contained in latent myostatin as one of the components, as described above. In certain embodiments, an anti-myostatin antibody of the present invention inhibits activation of myostatin. In certain embodiments, the anti-myostatin antibody blocks the release of mature myostatin from latent myostatin. It has been reported that mature myostatin is released via proteolytic and non-proteolytic processes from latent myostatin. The anti-myostatin antibody of the present invention may block the proteolytic and/or non-proteolytic release of mature myostatin from latent myostatin. In certain embodiments, the anti-myostatin antibody blocks the proteolytic cleavage of latent myostatin. In certain embodiments, the anti-myostatin antibody blocks access of a protease to latent myostatin (especially, to the proteolytic cleavage site (Arg98-Asp99) of latent myostatin). In further embodiments, the protease may be a BMP1/TLD family metalloprotease such as BMP1, TED, tolloid-like protein-1 (TLL-1), or tolloid-like protein-2 (TLL-2). In another embodiment, the anti-myostatin antibody blocks the non-proteolytic release of mature myostatin from latent myostatin. The non-proteolytic release as used herein means a spontaneous release of mature myostatin from latent myostatin, which is not accompanied by the proteolytic cleavage of latent myostatin. The non-proteolytic release includes, for example, a release of mature myostatin by incubating latent myostatin e.g., at 37° C. in the absence of a protease that cleaves the latent myostatin. In certain embodiments, the anti-myostatin antibody of the present invention does not bind to mature myostatin. In some embodiments, the anti-myostatin antibody binds to the same epitope as an antibody described in Table 2a. In some embodiments, the anti-myostatin antibody competes for binding latent myostatin with an antibody described in Table 2a. In additional embodiments, an anti-myostatin antibody competes for binding latent myostatin with an antibody comprising a VH and VL pair described in Table 2a. In some embodiments, the anti-myostatin antibody competes for binding a fragment consisting of amino acids 21-100 of myostatin propeptide (SEQ ID NO: 78) with an antibody described in Table 2a. In further embodiments, the anti-myostatin antibody binds to the same epitope as an antibody described in Table 11a or 13. In some embodiments, the anti-myostatin antibody competes for binding latent myostatin with an antibody described in Table 11a or 13. In some embodiments, the anti-myostatin antibody competes for binding a fragment consisting of amino acids 21-100 of myostatin propeptide (SEQ ID NO: 78) with an antibody described in Table 11a or 13.

In some embodiments, an anti-myostatin antibody of the present invention binds to latent myostatin and inhibits the activation of myostatin. In further embodiments, the antibody: (a) blocks the release of mature myostatin from latent myostatin; (b) blocks the proteolytic release of mature myostatin; (c) blocks the spontaneous release of mature myostatin; or (d) does not bind to mature myostatin; or (e) binds to an epitope within a fragment consisting of amino acids 21-100 of myostatin propeptide (SEQ ID NO: 78). In further embodiments, the antibody competes for binding latent myostatin with, or binds the same epitope as, an antibody comprising a VH and VL pair described in Tables 2a, 11a, or 13. In further embodiments, the antibody binds to latent myostatin with higher affinity at neutral pH (e.g., pH7.4) than at acidic pH (e.g., pH5.8). In further embodiments, the antibody is (a) a monoclonal antibody, (b) a human, humanized, or chimeric antibody; (c) a full length IgG antibody or (d) an antibody fragment that binds to latent myostatin or myostatin propeptide.

In another embodiment, an anti-myostatin antibody of the present invention does not bind to GDF11. In certain embodiments, an anti-myostatin antibody of the present invention does not inhibit activation of GDF11. In certain embodiments, the anti-myostatin antibody does not block the release of mature GDF11 from latent GDF11. The anti-myostatin antibody of the present invention does not block either proteolytic or non-proteolytic release of mature GDF11 from latent GDF11. In certain embodiments, the anti-myostatin antibody does not block the proteolytic cleavage of latent GDF11. In certain embodiments, the anti-myostatin antibody does not block access of a protease to latent GDF11 (especially, to the proteolytic cleavage site of latent GDF11). In further embodiments, the protease may be a BMP1/TLD family metalloprotease such as BMP1, TED, tolloid-like protein-1 (TLL-1), or tolloid-like protein-2 (TLL-2). The non-proteolytic release as used herein means a spontaneous release of mature GDF11 from latent GDF11, which is not accompanied by the proteolytic cleavage of latent GDF11. The non-proteolytic release includes, for example, a release of mature GDF11 by incubating latent GDF11 e.g., at 37° C. in the absence of a protease that cleaves the latent GDF11. Most of the anti-myostatin antibodies known to date were not specific for myostatin. These antibodies have high affinity for other members of the TGF-β superfamily, such as GDF11 and neutralize the biological activities of them. GDF11 plays an important role during embryogenesis, and is responsible for homeotic transformation of the axial skeleton. Homozygous GDF11 knockout mice are perinatal lethal, mice with one wild type copy of the GDF11 gene are viable but have skeletal defects. Since GDF11 plays an important role during embryogenesis, an antagonist that inhibits GDF11 poses theoretical safety risks that could present either as toxicity in treated patients or as reproductive toxicity in, e.g., women of childbearing potential. Thus, there is a need for specific inhibition of myostatin activity in treatments of myostatin-associated disorders for which it is desirable to increase muscle mass, size, strength, etc., particularly in women with childbearing potential.

In another aspect, the invention provides anti-myostatin antibodies that exhibit pH-dependent binding characteristics. As used herein, the expression "pH-dependent binding" means that the antibody exhibits "reduced binding to myostatin at acidic pH as compared to its binding at neutral pH" (for purposes of the present disclosure, both expressions may be used interchangeably). For example, antibodies "with pH-dependent binding characteristics" include antibodies that bind to myostatin with higher affinity at neutral pH than at acidic pH. In certain embodiments, the antibodies of the present invention bind to myostatin with at least 2, 3, 5, 10, 15, 20, 25, 30, 35, 40, 45, 50, 55, 60, 65, 70, 75, 80, 85, 90, 95, 100, 200, 400, 1000, 10000, or more times higher affinity at neutral pH than at acidic pH. In some embodiments, the antibodies bind to myostatin (e.g., latent myostatin or propeptide myostatin) with higher affinity at pH7.4 than at pH5.8. In further embodiments, the antibodies bind to myostatin with at least 2, 3, 5, 10, 15, 20, 25, 30, 35, 40, 45, 50, 55, 60, 65, 70, 75, 80, 85, 90, 95, 100, 200, 400, 1000, 10000, or more times higher affinity at pH7.4 than at pH5.8.

When an antigen is a soluble protein, the binding of an antibody to the antigen can result in an extended half-life of the antigen in plasma (i.e., reduced clearance of the antigen from plasma), since the antibody can have a longer half-life in plasma than the antigen itself and may serve as a carrier for the antigen. This is due to the recycling of the antigen-antibody complex by FcRn through the endosomal pathway in cell (Roopenian, *Nat. Rev. Immunol.* 7(9): 715-725 (2007)). However, an antibody with pH-dependent binding characteristics, which binds to its antigen in neutral extracellular environment while releasing the antigen into acidic endosomal compartments following its entry into cells, is expected to have superior properties in terms of antigen neutralization and clearance relative to its counterpart that binds in a pH-independent manner (Igawa et al., *Nature Biotechnol.* 28(11):1203-1207 (2010); Devanaboyina et al., *mAbs* 5(6):851-859 (2013); WO 2009/125825).

The "affinity" of an antibody for myostatin, for purposes of the present disclosure, is expressed in terms of the KD of the antibody. The KD of an antibody refers to the equilibrium dissociation constant of an antibody-antigen interaction. The greater the KD value is for an antibody binding to its antigen, the weaker its binding affinity is for that particular antigen. Accordingly, as used herein, the expression "higher affinity at neutral pH than at acidic pH" (or the equivalent expression "pH-dependent binding") means that the KD of the antibody binding to myostatin at acidic pH is greater than the KD of the antibody binding to myostatin at neutral pH. For example, in the context of the present invention, an antibody is considered to bind to myostatin with higher affinity at neutral pH than at acidic pH if the KD of the antibody binding to myostatin at acidic pH is at least 2 times greater than the KD of the antibody binding to myostatin at neutral pH. Thus, the present invention includes antibodies that bind to myostatin at acidic pH with a KD that is at least 2, 3, 5, 10, 15, 20, 25, 30, 35, 40, 45, 50, 55, 60, 65, 70, 75, 80, 85, 90, 95, 100, 200, 400, 1000, 10000, or more times greater than the KD of the antibody binding to myostatin at neutral pH. In another embodiment, the KD value of the antibody at neutral pH can be $10^{-7}$ M, $10^{-8}$ M, $10^{-9}$ M, $10^{-10}$ M, $10^{-11}$ M, $10^{-12}$ M, or less. In another embodiment, the KD value of the antibody at acidic pH can be $10^{-9}$ M, $10^{-8}$ M, $10^{-7}$ M, $10^{-6}$ M, or greater.

In further embodiments an antibody is considered to bind to myostatin (e.g., latent myostatin or propeptide myostatin) with a higher affinity at neutral pH than at acidic pH if the KD of the antibody binding to myostatin at pH5.8 is at least 2 times greater than the KD of the antibody binding to myostatin at pH7.4. In some embodiments the provided antibodies bind to myostatin at pH5.8 with a KD that is at least 3, 5, 10, 15, 20, 25, 30, 35, 40, 45, 50, 55, 60, 65, 70, 75, 80, 85, 90, 95, 100, 200, 400, 1000, 10000, or more times greater than the KD of the antibody binding to myostatin at pH7.4. In another embodiment, the KD value of the antibody at pH7.4 can be $10^{-7}$ M, $10^{-8}$ M, $10^{-9}$ M, $10^{-10}$ M, $10^{-11}$ M, $10^{-12}$ M, or less. In another embodiment, the KD value of the antibody at pH5.8 can be $10^{-9}$ M, $10^{-8}$ M, $10^{-7}$ M, $10^{-6}$ M, or greater.

The binding properties of an antibody for a particular antigen may also be expressed in terms of the kd of the antibody. The kd of an antibody refers to the dissociation rate constant of the antibody with respect to a particular antigen and is expressed in terms of reciprocal seconds (i.e., $\sec^{-1}$). An increase in kd value signifies weaker binding of an antibody to its antigen. The present invention therefore includes antibodies that bind to myostatin with a higher kd value at acidic pH than at neutral pH. The present invention includes antibodies that bind to myostatin at acidic pH with a kd that is at least 2, 3, 5, 10, 15, 20, 25, 30, 35, 40, 45, 50, 55, 60, 65, 70, 75, 80, 85, 90, 95, 100, 200, 400, 1000, 10000, or more times greater than the kd of the antibody binding to myostatin at neutral pH. In another embodiment, the kd value of the antibody at neutral pH can be $10^{-2}$ l/s, $10^{-3}$ l/s, $10^{-4}$ l/s, $10^{-5}$ l/s, $10^{-6}$ l/s, or less. In another embodiment, the kd value of the antibody at acidic pH can be $10^{-3}$ l/s, $10^{-2}$ l/s, $10^{-1}$ l/s, or greater. The invention also includes antibodies that bind to myostatin (e.g., latent myostatin or propeptide myostatin) with a higher kd value at pH5.8 than at pH7.4. The invention includes antibodies that bind to myostatin at pH5.8 with a kd that is at least 3, 5, 10, 15, 20, 25, 30, 35, 40, 45, 50, 55, 60, 65, 70, 75, 80, 85, 90, 95, 100, 200, 400, 1000, 10000, or more times greater than the kd of the antibody binding to myostatin at pH7.4. In another embodiment, the kd value of the antibody at pH7.4 can be $10^{-2}$ l/s, $10^{-3}$ l/s, $10^{-4}$ l/s, $10^{-5}$ l/s, $10^{-6}$ l/s, or less. In another embodiment, the kd value of the antibody at pH5.8 can be $10^{-3}$ l/s, $10^{-2}$ l/s, $10^{-1}$ l/s, or greater.

In certain instances, a "reduced binding to myostatin at acidic pH as compared to its binding at neutral pH" is expressed in terms of the ratio of the KD value of the antibody binding to myostatin at acidic pH to the KD value of the antibody binding to myostatin at neutral pH (or vice versa). For example, an antibody may be regarded as exhibiting "reduced binding to myostatin at acidic pH as compared to its binding at neutral pH", for purposes of the present invention, if the antibody exhibits an acidic/neutral KD ratio of 2 or greater. In certain embodiments, the pH5.8/pH7.4 KD ratio for an anti-myostatin antibody of the present invention is 2 or greater. In certain exemplary embodiments, the acidic/neutral KD ratio for an antibody of the present invention can be 2, 3, 5, 10, 15, 20, 25, 30, 35, 40, 45, 50, 55, 60, 65, 70, 75, 80, 85, 90, 95, 100, 200, 400, 1000, 10000, or greater. In another embodiment, the KD value of the antibody at neutral pH can be $10^{-7}$ M, $10^{-8}$ M, $10^{-9}$ M, $10^{-10}$ M, $10^{-11}$ M, $10^{-12}$ M, or less. In another embodiment, the KD value of the antibody at acidic pH can be $10^{-9}$ M, $10^{-8}$ M, $10^{-7}$ M, $10^{-6}$ M, or greater. In further instances an antibody may be regarded as exhibiting "reduced binding to myostatin (e.g., latent myostatin) at acidic pH as compared to its binding at neutral pH", if the antibody exhibits an pH5.8/pH7.4 KD ratio of 2 or greater. In certain exemplary embodiments, the pH5.8/pH7.4 KD ratio for the antibody can be 3, 5, 10, 15, 20, 25, 30, 35, 40, 45, 50, 55, 60, 65, 70, 75, 80, 85, 90, 95, 100, 200, 400, 1000, 10000, or greater. In another embodiment, the KD value of the antibody at pH7.4 can be $10^{-7}$ M, $10^{-8}$ M, $10^{-9}$ M, $10^{-10}$ M, $10^{-11}$ M, $10^{-12}$ M, or less. In another embodiment, the KD value of the antibody at pH5.8 can be $10^{-9}$ M, $10^{-8}$ M, $10^{-7}$ M, $10^{-6}$ M, or greater.

In certain instances, a "reduced binding to myostatin at acidic pH as compared to its binding at neutral pH" is expressed in terms of the ratio of the kd value of the antibody binding to myostatin at acidic pH to the kd value of the antibody binding to myostatin at neutral pH (or vice versa). For example, an antibody may be regarded as exhibiting "reduced binding to myostatin at acidic pH as compared to its binding at neutral pH", for purposes of the present invention, if the antibody exhibits an acidic/neutral kd ratio of 2 or greater. In certain exemplary embodiments, the pH5.8/pH7.4 kd ratio for an antibody of the present invention is 2 or greater. In certain exemplary embodiments, the acidic/neutral kd ratio for an antibody of the present invention can be 2, 3, 5, 10, 15, 20, 25, 30, 35, 40, 45, 50, 55, 60, 65, 70, 75, 80, 85, 90, 95, 100, 200, 400, 1000, 10000, or greater. In another embodiment, the kd value of the antibody at neutral pH can be $10^{-2}$ l/s, $10^{-3}$ l/s, $10^{-4}$ l/s, $10^{-5}$ l/s, $10^{-6}$ l/s, or less. In another embodiment, the kd value of the antibody at acidic pH can be $10^{-3}$ l/s, $10^{-2}$ l/s, $10^{-1}$ l/s, or greater. In certain exemplary embodiments, the pH5.8/pH7.4 kd ratio for an antibody of the present invention can be 2, 3, 5, 10, 15, 20, 25, 30, 35, 40, 45, 50, 55, 60, 65, 70, 75, 80, 85, 90, 95, 100, 200, 400, 1000, 10000, or greater. In another embodiment, the kd value of the antibody at pH7.4 can be $10^{-2}$ l/s, $10^{-3}$ l/s, $10^{-4}$ l/s, $10^{-5}$ l/s, $10^{-6}$ l/s, or less. In another embodiment, the kd value of the antibody at pH5.8 can be $10^{-3}$ l/s, $10^{-2}$ l/s, $10^{-1}$ l/s, or greater.

As used herein, the expression "acidic pH" means a pH of 4.0 to 6.5. The expression "acidic pH" includes pH values of any one of 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, and 6.5. In particular aspects, the "acidic pH" is 5.8.

As used herein, the expression "neutral pH" means a pH of 6.7 to about 10.0. The expression "neutral pH" includes pH values of any one of 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9, and 10.0. In particular aspects, the "neutral pH" is 7.4.

KD values, and kd values, as expressed herein, may be determined using a surface plasmon resonance-based biosensor to characterize antibody-antigen interactions. (See, e.g., Example 7, herein.) KD values, and kd values can be determined at 25° C. or 37° C.

In certain embodiments, an anti-myostatin antibody of the present invention binds to myostatin from more than one species. In further embodiments, the anti-myostatin antibody binds to myostatin from a human and non-human animal. In further embodiments, the anti-myostatin antibody binds to myostatin from human, mouse, and monkey (e.g., cynomolgus, rhesus macaque, marmoset, chimpanzee, or baboon).

In certain embodiments, an anti-myostatin antibody of the present invention binds to latent myostatin from more than one species. In further embodiments, the anti-myostatin antibody binds to latent myostatin from a human and non-human animal. In further embodiments, the anti-myostatin antibody binds to latent myostatin from human, mouse, and monkey.

In certain embodiments, an anti-myostatin antibody of the present invention binds to propeptide myostatin from more than one species. In further embodiments, the anti-myostatin antibody binds to propeptide myostatin from a human and non-human animal. In further embodiments, the anti-myostatin antibody binds to propeptide myostatin from human, mouse, and monkey.

In a further aspect, the invention provides an anti-myostatin antibody that forms an immune complex (i.e. antigen-antibody complex) with myostatin. In certain embodiments, two or more anti-myostatin antibodies bind to two or more myostatin molecules to form an immune complex. This is possible because myostatin exists as a homodimer containing two myostatin molecules while an antibody has two antigen-binding sites. The anti-myostatin antibody may bind to the same epitope on a myostatin molecule or may bind to different epitopes on a myostatin molecule, much like a bispecific antibody. Generally speaking, when two or more antibodies form an immune complex with two or more antigens, the resulting immune complex can strongly bind to Fc receptors existing on cell surfaces due to avidity effects through the Fc regions of the antibodies in the complex and can then be taken up into the cell with high efficiency. Thus, the above-mentioned anti-myostatin antibody capable of forming an immune complex containing two or more anti-myostatin antibodies and two or more myostatin molecules can lead to a rapid clearance of myostatin from plasma in a living body, via the strong binding to Fc receptors due to avidity effects.

Furthermore, an antibody with pH-dependent binding characteristics is thought to have superior properties in terms of antigen neutralization and clearance relative to its counterpart that binds in a pH-independent manner (Igawa et al., *Nature Biotech.* 28(11):1203-1207 (2010); Devanaboyina et al. *mAbs* 5(6):851-859 (2013); WO 2009/125825). Therefore, an antibody having both properties above, that is, an antibody which has pH-dependent binding characteristics and which forms an immune complex containing two or more antibodies with two or more antigens, is expected to have even more superior properties for highly accelerated elimination of antigens from plasma (WO 2013/081143).

In another aspect, the invention provides an anti-myostatin antibody comprising at least one, two, three, four, five, or six HVRs selected from (a) a HVR-H1 comprising the amino acid sequence of SEQ ID NO: 55-57, 114-115, or 126; (b) a HVR-H2 comprising the amino acid sequence of SEQ ID NO: 58-60, 116-120, or 127; (c) a HVR-H3 comprising the amino acid sequence of SEQ ID NO: 61-64, 121, or 128; (d) a HVR-L1 comprising the amino acid sequence of SEQ ID NO: 65-69, 122-124, or 129; (e) a HVR-L2 comprising the amino acid sequence of SEQ ID NO: 70-72, 125, or 130; and (f) a HVR-L3 comprising the amino acid sequence of SEQ ID NO: 73, 74, or 131.

In another aspect, the invention provides an anti-myostatin antibody comprising at least one, two, three, four, five, or six HVRs selected from (a) a HVR-H1 comprising the amino acid sequence of SEQ ID NO:55, 56, or 57; (b) a HVR-H2 comprising the amino acid sequence of SEQ ID NO:58, 59, or 60; (c) a HVR-H3 comprising the amino acid sequence of SEQ ID NO: 61, 62, 63, or 64; (d) a HVR-L1 comprising the amino acid sequence of SEQ ID NO: 65, 66, 67, 68, or 69; (e) a HVR-L2 comprising the amino acid sequence of SEQ ID NO: 70, 71, or 72; and (f) a HVR-L3 comprising the amino acid sequence of SEQ ID NO: 73 or 74.

In one aspect, the invention provides an anti-myostatin antibody comprising at least one, two, three, four, five, or six hypervariable regions (HVRs) selected from (a) a HVR-H1 comprising the amino acid sequence of SEQ ID NO: 114 or 115; (b) a HVR-H2 comprising the amino acid sequence of SEQ ID NO: 116-119, or 120; (c) a HVR-H3 comprising the amino acid sequence of SEQ ID NO: 121; (d) a HVR-L1 comprising the amino acid sequence of SEQ ID NO: 122, 123, or 124; (e) a HVR-L2 comprising the amino acid sequence of SEQ ID NO: 125; and (f) a HVR-L3 comprising the amino acid sequence of SEQ ID NO: 73 or 74.

In another aspect, the invention provides an anti-myostatin antibody comprising at least one, two, three, four, five, or six HVRs selected from (a) a HVR-H1 comprising the amino acid sequence of SEQ ID NO: 114; (b) a HVR-H2 comprising the amino acid sequence of SEQ ID NO: 58; (c) a HVR-H3 comprising the amino acid sequence of SEQ ID NO: 63; (d) a HVR-L1 comprising the amino acid sequence of SEQ ID NO: 122; (e) a HVR-L2 comprising the amino acid sequence of SEQ ID NO: 71; and (f) a HVR-L3 comprising the amino acid sequence of SEQ ID NO: 74.

In another aspect, the invention provides an anti-myostatin antibody comprising at least one, two, three, four, five, or six HVRs selected from (a) a HVR-H1 comprising the amino acid sequence of SEQ ID NO: 114; (b) a HVR-H2 comprising the amino acid sequence of SEQ ID NO: 58; (c) a HVR-H3 comprising the amino acid sequence of SEQ ID NO: 63; (d) a HVR-L1 comprising the amino acid sequence of SEQ ID NO: 123; (e) a HVR-L2 comprising the amino acid sequence of SEQ ID NO: 71; and (f) a HVR-L3 comprising the amino acid sequence of SEQ ID NO: 74.

In another aspect, the invention provides an anti-myostatin antibody comprising at least one, two, three, four, five, or six HVRs selected from (a) a HVR-H1 comprising the amino acid sequence of SEQ ID NO: 126; (b) a HVR-H2 comprising the amino acid sequence of SEQ ID NO: 127; (c) a HVR-H3 comprising the amino acid sequence of SEQ ID NO: 128; (d) a HVR-L1 comprising the amino acid sequence of SEQ ID NO: 129; (e) a HVR-L2 comprising the amino acid sequence of SEQ ID NO: 130; and (f) a HVR-L3 comprising the amino acid sequence of SEQ ID NO: 131.

In one aspect, the invention provides an antibody comprising at least one, at least two, or all three VH HVR sequences selected from (a) a HVR-H1 comprising the amino acid sequence of SEQ ID NO: 55-57, 114-115, or 126; (b) a HVR-H2 comprising the amino acid sequence of SEQ ID NO; 58-60, 116-120, or 127; (c) a HVR-H3 comprising the amino acid sequence of SEQ ID NO: 61-64, 121, or 128. In one embodiment, the antibody comprises a HVR-H3 comprising the amino acid sequence of SEQ ID NO: 61-64, 121, or 128. In another embodiment, the antibody comprises a HVR-H3 comprising the amino acid sequence of SEQ ID NO: 61-64, 121, or 128 and HVR-L3 comprising the amino acid sequence of SEQ ID NO: 73, 74, or 131. In a further embodiment, the antibody comprises a HVR-H3 comprising the amino acid sequence of SEQ ID NO: 61-64, 121, or 128, HVR-L3 comprising the amino acid sequence of SEQ ID NO: 73, 74, or 131, and HVR-H2 comprising the amino acid sequence of SEQ ID NO: 58-60, 116-120, or 127. In a further embodiment, the antibody comprises (a) a HVR-H1 comprising the amino acid sequence of SEQ ID NO: 55-57, 114-115, or 126; (b) a HVR-H2 comprising the amino acid sequence of SEQ ID NO: 58-60, 116-120, or 127; and (c) a HVR-H3 comprising the amino acid sequence of SEQ ID NO: 61-64, 121, or 128.

In one aspect, the invention provides an antibody comprising at least one, at least two, or all three VH HVR sequences selected from (a) a HVR-H1 comprising the amino acid sequence of SEQ ID NO:55, 56, or 57; (b) a HVR-H2 comprising the amino acid sequence of SEQ ID NO:58, 59, or 60; and (c) a HVR-H3 comprising the amino acid sequence of SEQ ID NO: 61, 62, 63, or 64. In one embodiment, the antibody comprises a HVR-H3 comprising the amino acid sequence of SEQ ID NO: 61, 62, 63, or 64. In another embodiment, the antibody comprises a HVR-H3 comprising the amino acid sequence of SEQ ID NO: 61, 62, 63, or 64 and HVR-L3 comprising the amino acid sequence of SEQ ID NO: 73 or 74. In a further embodiment, the antibody comprises a HVR-H3 comprising the amino acid sequence of SEQ ID NO: 61, 62, 63, or 64, HVR-L3 comprising the amino acid sequence of SEQ ID NO: 73 or 74, and HVR-H2 comprising the amino acid sequence of SEQ ID NO:58, 59, or 60. In a further embodiment, the antibody comprises (a) a HVR-H1 comprising the amino acid sequence of SEQ ID NO:55, 56, or 57; (b) a HVR-H2 comprising the amino acid sequence of SEQ ID NO:58, 59, or 60; and (c) a HVR-H3 comprising the amino acid sequence of SEQ ID NO: 61, 62, 63, or 64.

In another aspect, the invention provides an antibody comprising at least one, at least two, or all three VH HVR sequences selected from (a) a HVR-H1 comprising the amino acid sequence of SEQ ID NO: 114 or 115; (b) a HVR-H2 comprising the amino acid sequence of SEQ ID NO: 116-119, or 120; and (c) a HVR-H3 comprising the amino acid sequence of SEQ ID NO: 121. In one embodiment, the antibody comprises a HVR-H3 comprising the amino acid sequence of SEQ ID NO: 121. In another embodiment, the antibody comprises a HVR-H3 comprising the amino acid sequence of SEQ ID NO: 121 and HVR-L3 comprising the amino acid sequence of SEQ ID NO: 73 or 74. In a further embodiment, the antibody comprises a HVR-H3 comprising the amino acid sequence of SEQ ID NO: 121, HVR-L3 comprising the amino acid sequence of SEQ ID NO: 73 or 74, and HVR-H2 comprising the amino acid sequence of SEQ ID NO: 116-119, or 120. In a further embodiment, the antibody comprises (a) a HVR-H1 comprising the amino acid sequence of SEQ ID NO: 114 or 15; (b) a HVR-H2 comprising the amino acid sequence of SEQ ID NO: 116-119, or 120; and (c) a HVR-H3 comprising the amino acid sequence of SEQ ID NO: 121.

In another aspect, the invention provides an antibody comprising at least one, at least two, or all three VH HVR sequences selected from (a) a HVR-H1 comprising the amino acid sequence of SEQ ID NO: 114; (b) a HVR-H2 comprising the amino acid sequence of SEQ ID NO: 58; and (c) a HVR-H3 comprising the amino acid sequence of SEQ ID NO: 63. In one embodiment, the antibody comprises a HVR-H3 comprising the amino acid sequence of SEQ ID NO: 63. In another embodiment, the antibody comprises a HVR-H3 comprising the amino acid sequence of SEQ ID NO: 63 and HVR-L3 comprising the amino acid sequence of SEQ ID NO: 74. In a further embodiment, the antibody comprises a HVR-H3 comprising the amino acid sequence of SEQ ID NO: 63, HVR-L3 comprising the amino acid sequence of SEQ ID NO: 74, and HVR-H2 comprising the amino acid sequence of SEQ ID NO: 58. In a further embodiment, the antibody comprises (a) a HVR-H1 comprising the amino acid sequence of SEQ ID NO: 114; (b) a HVR-H2 comprising the amino acid sequence of SEQ ID NO: 58; and (c) a HVR-H3 comprising the amino acid sequence of SEQ ID NO: 63.

In another aspect, the invention provides an antibody comprising at least one, at least two, or all three VH HVR sequences selected from (a) a HVR-H1 comprising the amino acid sequence of SEQ ID NO: 126; (b) a HVR-H2 comprising the amino acid sequence of SEQ ID NO: 127; and (c) a HVR-H3 comprising the amino acid sequence of SEQ ID NO: 128. In one embodiment, the antibody comprises a HVR-H3 comprising the amino acid sequence of SEQ ID NO: 128. In another embodiment, the antibody comprises a HVR-H3 comprising the amino acid sequence of SEQ ID NO: 128 and HVR-L3 comprising the amino acid sequence of SEQ ID NO: 131. In a further embodiment, the antibody comprises a HVR-H3 comprising the amino acid sequence of SEQ ID NO: 128, HVR-L3 comprising the amino acid sequence of SEQ ID NO: 131, and HVR-H2 comprising the amino acid sequence of SEQ ID NO: 127. In a further embodiment, the antibody comprises (a) a HVR-H1 comprising the amino acid sequence of SEQ ID NO: 126; (b) a HVR-H2 comprising the amino acid sequence of SEQ ID NO: 127; and (c) a HVR-H3 comprising the amino acid sequence of SEQ ID NO: 128.

In another aspect, the invention provides an antibody comprising at least one, at least two, or all three VL HVR sequences selected from (a) a HVR-L1 comprising the amino acid sequence of SEQ ID NO: 65, 66, 67, 68, or 69, 122-124, 129; (b) a HVR-L2 comprising the amino acid sequence of SEQ ID NO: 70-72, 125, or 130; and (c) a HVR-L3 comprising the amino acid sequence of SEQ ID NO: 73, 74, or 131. In one embodiment, the antibody comprises (a) a HVR-L1 comprising the amino acid sequence of SEQ ID NO: 65, 66, 67, 68, or 69, 122-124, 129; (b) a HVR-L2 comprising the amino acid sequence of SEQ ID NO: 70-72, 125, or 130; and (c) a HVR-L3 comprising the amino acid sequence of SEQ ID NO: 73, 74, or 131.

In another aspect, the invention provides an antibody comprising at least one, at least two, or all three VL HVR sequences selected from (a) a HVR-L1 comprising the amino acid sequence of SEQ ID NO: 65, 66, 67, 68, or 69; (b) a HVR-L2 comprising the amino acid sequence of SEQ ID NO: 70, 71, or 72; and (c) a HVR-L3 comprising the amino acid sequence of SEQ ID NO: 73 or 74. In one embodiment, the antibody comprises (a) a HVR-L1 comprising the amino acid sequence of SEQ ID NO: 65, 66, 67, 68, or 69; (b) a HVR-L2 comprising the amino acid sequence of SEQ ID NO: 70, 71, or 72; and (c) a HVR-L3 comprising the amino acid sequence of SEQ ID NO: 73 or 74. In another aspect, the invention provides an antibody comprising at least one, at least two, or all three VL HVR sequences selected from (a) a HVR-L1 comprising the amino acid sequence of SEQ ID NO: 122, 123, or 124; (b) a HVR-L2 comprising the amino acid sequence of SEQ ID NO: 125; and (c) a HVR-L3 comprising the amino acid sequence of SEQ ID NO: 73 or 74. In one embodiment, the antibody comprises (a) a HVR-L1 comprising the amino acid sequence of SEQ ID NO: 122, 123, or 124; (b) a HVR-L2 comprising the amino acid sequence of SEQ ID NO: 125; and (c) a HVR-L3 comprising the amino acid sequence of SEQ ID NO: 73 or 74.

In another aspect, the invention provides an antibody comprising at least one, at least two, or all three VL HVR sequences selected from (a) a HVR-L comprising the amino acid sequence of SEQ ID NO: 122; (b) a HVR-L2 comprising the amino acid sequence of SEQ ID NO: 71; and (c) a HVR-L3 comprising the amino acid sequence of SEQ ID NO: 74. In one embodiment, the antibody comprises (a) a HVR-L1 comprising the amino acid sequence of SEQ ID NO: 122; (b) a HVR-L2 comprising the amino acid sequence of SEQ ID NO: 71; and (c) a HVR-L3 comprising the amino acid sequence of SEQ ID NO: 74. In another aspect, the invention provides an antibody comprising at least one, at least two, or all three VL HVR sequences selected from (a) a HVR-L1 comprising the amino acid sequence of SEQ ID NO: 123; (b) a HVR-L2 comprising the amino acid sequence of SEQ ID NO: 71; and (c) a HVR-L3 comprising the amino acid sequence of SEQ ID NO: 74. In one embodiment, the antibody comprises (a) a HVR-L1 comprising the amino acid sequence of SEQ ID NO: 123; (b) a HVR-L2 comprising the amino acid sequence of SEQ ID NO: 71; and (c) a HVR-L3 comprising the amino acid sequence of SEQ ID NO: 74

In another aspect, the invention provides an antibody comprising at least one, at least two, or all three VL HVR sequences selected from (a) a HVR-L1 comprising the amino acid sequence of SEQ ID NO: 129; (b) a HVR-L2 comprising the amino acid sequence of SEQ ID NO: 130; and (c) a HVR-L3 comprising the amino acid sequence of SEQ ID NO: 131. In one embodiment, the antibody comprises (a) a HVR-L1 comprising the amino acid sequence of SEQ ID NO: 129; (b) a HVR-L2 comprising the amino acid sequence of SEQ ID NO: 130; and (c) a HVR-L3 comprising the amino acid sequence of SEQ ID NO 131.

In another aspect, an antibody of the invention comprises (a) a VH domain comprising at least one, at least two, or all three VH HVR sequences selected from (i) a HVR-H1 comprising the amino acid sequence of SEQ ID NO:55, 56, or 57, 114, 115, 126 (ii) a HVR-H2 comprising the amino acid sequence of SEQ ID NO: 58-60, 116-120, or 127, and (iii) a HVR-H3 comprising the amino acid sequence of SEQ ID NO: 61-64, 121, or 128; and (b) a VL domain comprising at least one, at least two, or all three VL HVR sequences selected from (i) a HVR-L1 comprising the amino acid sequence of SEQ ID NO: 65-69, 122-124, or 129, (ii) a HVR-L2 comprising the amino acid sequence of SEQ ID NO: 70-72, 125, or 130 and (c) a HVR-L3 comprising the amino acid sequence of SEQ ID NO: 73, 74, or 131.

In another aspect, an antibody of the invention comprises (a) a VH domain comprising at least one, at least two, or all three VH HVR sequences selected from (i) a HVR-H1 comprising the amino acid sequence of SEQ ID NO:55, 56, or 57, (ii) a HVR-H2 comprising the amino acid sequence of SEQ ID NO:58, 59, or 60, and (iii) a HVR-H3 comprising the amino acid sequence of SEQ ID NO: 61, 62, 63, or 64; and (b) a VL domain comprising at least one, at least two, or all three VL HVR sequences selected from (i) a HVR-L comprising the amino acid sequence of SEQ ID NO: 65, 66, 67, 68, or 69, (ii) a HVR-L2 comprising the amino acid sequence of SEQ ID NO: 70, 71, or 72, and (c) a HVR-L3 comprising the amino acid sequence of SEQ ID NO: 73 or 74.

In another aspect, an antibody of the invention comprises (a) a VH domain comprising at least one, at least two, or all three VH HVR sequences selected from (i) a HVR-H1 comprising the amino acid sequence of SEQ ID NO: 114 or 115, (ii) a HVR-H2 comprising the amino acid sequence of SEQ ID NO: 116-119, or 120, and (iii) a HVR-H3 comprising the amino acid sequence of SEQ ID NO: 121; and (b) a VL domain comprising at least one, at least two, or all three VL HVR sequences selected from (i) a HVR-L1 comprising the amino acid sequence of SEQ ID NO: 122, 123, or 124, (ii) a HVR-L2 comprising the amino acid sequence of SEQ ID NO: 125, and (c) a HVR-L3 comprising the amino acid sequence of SEQ ID NO: 73 or 74.

In another aspect, an antibody of the invention comprises (a) a VH domain comprising at least one, at least two, or all three VH HVR sequences selected from (i) a HVR-H1 comprising the amino acid sequence of SEQ ID NO: 114, (ii) a HVR-H2 comprising the amino acid sequence of SEQ ID NO: 58, and (iii) a HVR-H3 comprising the amino acid sequence of SEQ ID NO: 63; and (b) a VL domain comprising at least one, at least two, or all three VL HVR sequences selected from (i) a HVR-L1 comprising the amino acid sequence of SEQ ID NO: 122, (ii) a HVR-L2 comprising the amino acid sequence of SEQ ID NO: 71, and (c) a HVR-L3 comprising the amino acid sequence of SEQ ID NO: 74.

In another aspect, an antibody of the invention comprises (a) a VH domain comprising at least one, at least two, or all three VH HVR sequences selected from (i) a HVR-H1 comprising the amino acid sequence of SEQ ID NO: 114, (ii) a HVR-H2 comprising the amino acid sequence of SEQ ID NO: 58, and (iii) a HVR-H3 comprising the amino acid sequence of SEQ ID NO: 63; and (b) a VL domain comprising at least one, at least two, or all three VL HVR sequences selected from (i) a HVR-L1 comprising the amino acid sequence of SEQ ID NO: 123, (ii) a HVR-L2 comprising the amino acid sequence of SEQ ID NO: 71, and (c) a HVR-L3 comprising the amino acid sequence of SEQ ID NO: 74.

In another aspect, an antibody of the invention comprises (a) a VH domain comprising at least one, at least two, or all three VH HVR sequences selected from (i) a HVR-H1 comprising the amino acid sequence of SEQ ID NO: 126, (ii) a HVR-H2 comprising the amino acid sequence of SEQ ID NO: 127, and (iii) a HVR-H3 comprising the amino acid sequence of SEQ ID NO: 128; and (b) a VL domain comprising at least one, at least two, or all three VL HVR sequences selected from (i) a HVR-L1 comprising the amino acid sequence of SEQ ID NO: 129, (ii) a HVR-L2 comprising the amino acid sequence of SEQ ID NO: 130, and (c) a HVR-L3 comprising the amino acid sequence of SEQ ID NO: 131.

In another aspect, the invention provides an antibody comprising (a) a HVR-H1 comprising the amino acid sequence of SEQ ID NO: 55-57, 114-115, or 126; (b) a HVR-H2 comprising the amino acid sequence of SEQ ID NO: 58-60, 116-120, or 127; (c) a HVR-H3 comprising the amino acid sequence of SEQ ID NO: 61-64, 121, or 128; (d) a HVR-L1 comprising the amino acid sequence of SEQ ID NO: 65-69, 122-124, or 129; (e) a HVR-L2 comprising the amino acid sequence of SEQ ID NO: 70-72, 125, or 130; and (f) a HVR-L3 comprising the amino acid sequence of SEQ ID NO: 73, 74, or 131.

In another aspect, the invention provides an antibody comprising (a) a HVR-H1 comprising the amino acid sequence of SEQ ID NO:55, 56, or 57, 114-115; (b) a HVR-H2 comprising the amino acid sequence of SEQ ID NO:58, 59, or 60, 116-120; (c) a HVR-H3 comprising the amino acid sequence of SEQ ID NO: 61, 62, 63, or 64, 121; (d) a HVR-L1 comprising the amino acid sequence of SEQ ID NO: 65, 66, 67, 68, or 69, 122-124; (e) a HVR-L2 comprising the amino acid sequence of SEQ ID NO: 70, 71, or 72, 125; and (f) a HVR-L3 comprising the amino acid sequence of SEQ ID NO: 73 or 74.

In another aspect, the invention provides an antibody comprising (a) a HVR-H1 comprising the amino acid sequence of SEQ ID NO: 114 or 115; (b) a HVR-H2 comprising the amino acid sequence of SEQ ID NO: 116-119, or 120; (c) a HVR-H3 comprising the amino acid sequence of SEQ ID NO: 121; (d) a HVR-L1 comprising the amino acid sequence of SEQ ID NO: 122, 123, or 124; (e) a HVR-L2 comprising the amino acid sequence of SEQ ID NO: 125; and (f) a HVR-L3 comprising the amino acid sequence of SEQ ID NO: 73 or 74.

In another aspect, the invention provides an antibody comprising (a) a HVR-H1 comprising the amino acid sequence of SEQ ID NO: 114; (b) a HVR-H2 comprising the amino acid sequence of SEQ ID NO: 58; (c) a HVR-H3 comprising the amino acid sequence of SEQ ID NO: 63; (d) a HVR-L1 comprising the amino acid sequence of SEQ ID NO: 122; (e) a HVR-L2 comprising the amino acid sequence of SEQ ID NO: 71; and (f) a HVR-L3 comprising the amino acid sequence of SEQ ID NO: 74.

In another aspect, the invention provides an antibody comprising (a) a HVR-H1 comprising the amino acid sequence of SEQ ID NO: 114; (b) a HVR-H2 comprising the amino acid sequence of SEQ ID NO: 58; (c) a HVR-H3 comprising the amino acid sequence of SEQ ID NO: 63; (d) a HVR-L1 comprising the amino acid sequence of SEQ ID NO: 123; (e) a HVR-L2 comprising the amino acid sequence of SEQ ID NO: 71; and (f) a HVR-L3 comprising the amino acid sequence of SEQ ID NO: 74.

In another aspect, the invention provides an antibody comprising (a) a HVR-H1 comprising the amino acid sequence of SEQ ID NO: 126; (b) a HVR-H2 comprising the amino acid sequence of SEQ ID NO: 127; (c) a HVR-H3 comprising the amino acid sequence of SEQ ID NO: 128; (d) a HVR-L1 comprising the amino acid sequence of SEQ ID NO: 129; (e) a HVR-L2 comprising the amino acid sequence of SEQ ID NO: 130; and (f) a HVR-L3 comprising the amino acid sequence of SEQ ID NO: 131.

In certain embodiments, any one or more amino acids of an anti-myostatin antibody as provided above are substituted at the following HVR positions: (a) in HVR-H1 (SEQ ID NO: 55), at positions 1, and 2; (b) in HVR-H2 (SEQ ID NO: 58), at positions 4, 7, 8, 10, 11, 12, and 16; (c) in HVR-H3 (SEQ ID NO: 61), at positions 5, 7, and 11; (d) in HVR-L1 (SEQ ID NO: 65), at positions 1, 2, 5, 7, 8, and 9; (e) in HVR-L2 (SEQ ID NO:70), at positions 3, and 7; and (f) in HVR-L3 (SEQ ID NO:73), at position 8.

In certain embodiments, the one or more amino acid substitutions of an anti-myostatin antibody are conservative substitutions, as provided herein. In certain embodiments, any one or more of the following substitutions may be made in any combination: (a) in HVR-H1 (SEQ ID NO: 55), S1H; Y2T, D, or E; (b) in HVR-H2 (SEQ ID NO: 58), Y4H; S7K; T8M or K; Y10K; A11M or E; S12E; G16K; (c) in HVR-H3 (SEQ ID NO: 61), Y5H; T7H; L11K; (d) in HVR-L1 (SEQ ID NO: 65), Q1T; S2T; S5E; Y7F; D8H; N9D or A or E; (e) in HVR-L2 (SEQ ID NO: 70), S3E; S7Y, F or W; and (f) in HVR-L3 (SEQ ID NO: 73), L8R.

All possible combinations of the above substitutions are encompassed by the consensus sequences of SEQ ID NOs: 126, 127, 128, 129, 130, and 131, for HVR-H1, HVR-H2, HVR-H3, HVR-L1, HVR-L2, and HVR-L3, respectively.

In any of the above embodiments, an anti-myostatin antibody can be humanized. In one embodiment, an anti-myostatin antibody comprises HVRs as in any of the above embodiments, and further comprises an acceptor human framework, e.g., a human immunoglobulin framework or a human consensus framework. In another embodiment, an anti-myostatin antibody comprises HVRs as in any of the above embodiments, and further comprises a VH or VL comprising an FR sequence. In a further embodiment, the anti-myostatin antibody comprises the following heavy chain and/or light chain variable domain FR sequences: For the heavy chain variable domain, the FR1 comprises the amino acid sequence of SEQ ID NO: 132, 133, or 134, FR2 comprises the amino acid sequence of SEQ ID NO: 135 or 136, FR3 comprises the amino acid sequence of SEQ ID NO: 137, FR4 comprises the amino acid sequence of SEQ ID NO: 138. For the light chain variable domain, FR1 comprises the amino acid sequence of SEQ ID NO: 139, FR2 comprises the amino acid sequence of SEQ ID NO: 140 or 141, FR3 comprises the amino acid sequence of SEQ ID NO: 142 or 143, FR4 comprises the amino acid sequence of SEQ ID NO: 144.

In one aspect, the invention provides an anti-myostatin antibody comprising at least one, two, three, four, five, or six HVRs selected from (a) a HVR-H1 comprising the amino acid sequence of SEQ ID NO: 157-161, or 162; (b) a HVR-H2 comprising the amino acid sequence of SEQ ID NO: 163-167, or 168; (c) a HVR-H3 comprising the amino acid sequence of SEQ ID NO: 169-173, or 174; (d) a HVR-L1 comprising the amino acid sequence of SEQ ID NO: 175-179, or 180; (e) a HVR-L2 comprising the amino acid sequence of SEQ ID NO: 181-185, or 186; and (f) a HVR-L3 comprising the amino acid sequence of SEQ ID NO: 187-191, or 192.

In one aspect, the invention provides an antibody comprising at least one, at least two, or all three VH HVR sequences selected from (a) a HVR-H1 comprising the amino acid sequence of SEQ ID NO: 157-161, or 162; (b) a HVR-H2 comprising the amino acid sequence of SEQ ID NO: 163-167, or 168; and (c) a HVR-H3 comprising the amino acid sequence of SEQ ID NO: 169-173, or 174. In one embodiment, the antibody comprises a HVR-H3 comprising the amino acid sequence of SEQ ID NO: 169-173, or 174. In another embodiment, the antibody comprises a HVR-H3 comprising the amino acid sequence of SEQ ID NO: 169-173, or 174 and HVR-L3 comprising the amino acid sequence of SEQ ID NO: 187-191, or 192. In a further embodiment, the antibody comprises a HVR-H3 comprising the amino acid sequence of SEQ ID NO: 169-173, or 174, HVR-L3 comprising the amino acid sequence of SEQ ID NO: 187-191, or 192, and a HVR-H2 comprising the amino acid sequence of SEQ ID NO: 163-167, or 168. In a further embodiment, the antibody comprises (a) a HVR-H1 comprising the amino acid sequence of SEQ ID NO: 157-161, or 162; (b) a HVR-H2 comprising the amino acid sequence of SEQ ID NO: 163-167, or 168; and (c) a HVR-H3 comprising the amino acid sequence of SEQ ID NO: 169-173, or 174.

In another aspect, the invention provides an antibody comprising at least one, at least two, or all three VL HVR sequences selected from (a) a HVR-L1 comprising the amino acid sequence of SEQ ID NO: 175-179, or 180; (b) a HVR-L2 comprising the amino acid sequence of SEQ ID NO: 181-185, or 186; and (c) a HVR-L3 comprising the amino acid sequence of SEQ ID NO: 187-191, or 192. In one embodiment, the antibody comprises (a) a HVR-L1 comprising the amino acid sequence of SEQ ID NO: 175-179, or 180; (b) a HVR-L2 comprising the amino acid sequence of SEQ ID NO: 181-185, or 186; and (c) a HVR-L3 comprising the amino acid sequence of SEQ ID NO: 187-191, or 192.

In another aspect, an antibody of the invention comprises (a) a VH domain comprising at least one, at least two, or all three VH HVR sequences selected from (i) a HVR-H1 comprising the amino acid sequence of SEQ ID NO: 157-161, or 162, (ii) a HVR-H2 comprising the amino acid sequence of SEQ ID NO: 163-167, or 168, and (iii) a HVR-H3 comprising the amino acid sequence of SEQ ID NO: 169-173, or 174; and (b) a VL domain comprising at least one, at least two, or all three VL HVR sequences selected from (i) a HVR-L1 comprising the amino acid sequence of SEQ ID NO: 175-179, or 180, (ii) a HVR-L2 comprising the amino acid sequence of SEQ ID NO: 181-185, or 186, and (c) a HVR-L3 comprising the amino acid sequence of SEQ ID NO: 187-191, or 192.

In another aspect, the invention provides an antibody comprising (a) a HVR-H1 comprising the amino acid sequence of SEQ ID NO: 157-161, or 162; (b) a HVR-H2 comprising the amino acid sequence of SEQ ID NO: 163-167, or 168; (c) a HVR-H3 comprising the amino acid sequence of SEQ ID NO: 169-173, or 174; (d) a HVR-L1 comprising the amino acid sequence of SEQ ID NO: 175-179, or 180; (e) a HVR-L2 comprising the amino acid sequence of SEQ ID NO: 181-185, or 186; and (f) a HVR-L3 comprising the amino acid sequence of SEQ ID NO: 187-191, or 192.

In another aspect, an anti-myostatin antibody comprises a heavy chain variable domain (VH) sequence having at least 90%, 91%, 92%, 93%, 94%, 95%, 96%, 97%, 98%, 99%, or 100% sequence identity to the amino acid sequence of SEQ ID NO: 13, 16-30, 32-34, 86-94, or 95. In certain embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 13, 16-30, 32, 33, or 34. In certain embodiments, substitutions, insertions, or deletions occur in regions outside the HVRs (i.e., in the FRs). Optionally, the anti-myostatin antibody comprises the VH sequence in SEQ ID NO: 13, 16-30, 32, 33, or 34, including post-translational modifications of that sequence. In a particular embodiment, the VH comprises one, two or three HVRs selected from: (a) a HVR-H1 comprising the amino acid sequence of SEQ ID NO:55, 56, or 57, (b) a HVR-H2 comprising the amino acid sequence of SEQ ID NO:58, 59, or 60, and (c) a HVR-H3 comprising the amino acid sequence of SEQ ID NO: 61, 62, 63, or 64.

In another aspect, an anti-myostatin antibody comprises a heavy chain variable domain (VH) sequence having at least 90%, 91%, 92%, 93%, 94%, 95%, 96%, 97%, 98%, 99%, or 100% sequence identity to the amino acid sequence of SEQ ID NO: 13, 16-30, 32-34, 86-94, or 95. In certain embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 13, 16-30, 32-34, 86-94, or 95. In certain embodiments, substitutions, insertions, or deletions occur in regions outside the HVRs (i.e., in the FRs). Optionally, the anti-myostatin antibody comprises the VH sequence in SEQ ID NO: 13, 16-30, 32-34, 86-94, or 95, including post-translational modifications of that sequence. In a particular embodiment, the VH comprises one, two or three HVRs selected from: (a) a HVR-H1 comprising the amino acid sequence of SEQ ID NO: 55-57, 114-115, or 126, (b) a HVR-H2 comprising the amino acid sequence of SEQ ID NO: 58-60, 116-120, or 127, and (c) a HVR-H3 comprising the amino acid sequence of SEQ ID NO: 61-64, 121, or 128.

In another aspect, an anti-myostatin antibody comprises a VH sequence having at least 90%, 91%, 92%, 93%, 94%, 95%, 96%, 97%, 98%, 99%, or 100% sequence identity to the amino acid sequence of SEQ ID NO: 13, 16-30, 32, 33, or 34. In certain embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 13, 16-30, 32, 33 or 34. In certain embodiments, substitutions, insertions, or deletions occur in regions outside the HVRs (i.e., in the FRs). Optionally, the anti-myostatin antibody comprises the VH sequence in SEQ ID NO: 13, 16-30, 32, 33, or 34, including post-translational modifications of that sequence. In a particular embodiment, the VH comprises one, two or three HVRs selected from: (a) a HVR-H1 comprising the amino acid sequence of SEQ ID NO:55, 56, or 57, (b) a HVR-H2 comprising the amino acid sequence of SEQ ID NO:58, 59, or 60, and (c) a HVR-H3 comprising the amino acid sequence of SEQ ID NO: 61, 62, 63, or 64.

In another aspect, an anti-myostatin antibody comprises a VH sequence having at least 90%, 91%, 92%, 93%, 94%, 95%, 96%, 97%, 98%, 99%, or 100% sequence identity to the amino acid sequence of SEQ ID NO: 86-94, or 95. In certain embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 86-94, or 95. In certain embodiments, substitutions, insertions, or deletions occur in regions outside the HVRs (i.e., in the FRs). Optionally, the anti-myostatin antibody comprises the VH sequence in SEQ ID NO: 86-94, or 95, including post-translational modifications of that sequence. In a particular embodiment, the VH comprises one, two or three HVRs selected from: (a) a HVR-H1 comprising the amino acid sequence of SEQ ID NO: 114, 115, or 126, (b) a HVR-H2 comprising the amino acid sequence of SEQ ID NO: 116-119, 120, or 127, and (c) a HVR-H3 comprising the amino acid sequence of SEQ ID NO:121 or 128. In some embodiments, the antibody further comprises the variant Fc region amino acid sequence of SEQ ID NO: 229-380, or 381.

In another aspect, an anti-myostatin antibody comprises a VH sequence having at least 90%, 91%, 92%, 93%, 94%, 95%, 96%, 97%, 98%, 99%, or 100% sequence identity to the amino acid sequence of SEQ ID NO: 86. In certain embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 86. In certain embodiments, substitutions, insertions, or deletions occur in regions outside the HVRs (i.e., in the FRs). Optionally, the anti-myostatin antibody comprises the VH sequence in SEQ ID NO: 86, including post-translational modifications of that sequence. In a particular embodiment, the VH comprises one, two or three HVRs selected from: (a) a HVR-H1 comprising the amino acid sequence of SEQ ID NO: 114, (b) a HVR-H2 comprising the amino acid sequence of SEQ ID NO: 58, and (c) a HVR-H3 comprising the amino acid sequence of SEQ ID NO: 63. In some embodiments, the antibody further comprises the variant Fc region amino acid sequence of SEQ ID NO: 229-380, or 381.

In another aspect, an anti-myostatin antibody comprises a VH sequence having at least 90%, 91%, 92%, 93%, 94%, 95%, 96%, 97%, 98%, 99%, or 100% sequence identity to the amino acid sequence of SEQ ID NO: 92. In certain embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 92. In certain embodiments, substitutions, insertions, or deletions occur in regions outside the HVRs (i.e., in the FRs). Optionally, the anti-myostatin antibody comprises the VH sequence in SEQ ID NO: 92, including post-translational modifications of that sequence. In a particular embodiment, the VI comprises one, two or three HVRs selected from: (a) a HVR-H1 comprising the amino acid sequence of SEQ ID NO: 114, (b) a HVR-H2 comprising the amino acid sequence of SEQ ID NO: 58, and (c) a HVR-H3 comprising the amino acid sequence of SEQ ID NO: 63. In some embodiments, the antibody further comprises the variant Fc region amino acid sequence of SEQ ID NO: 229-380, or 381.

In another aspect, an anti-myostatin antibody is provided, wherein the antibody comprises a VL having at least 90%, 91%, 92%, 93%, 94%, 95%, 96%, 97%, 98%, 99%, or 100% sequence identity to the amino acid sequence of SEQ ID NO:15, 31, 35-38, 96-98, or 99. In certain embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 15, 31, 35-38, 96-98, or 99. In certain embodiments, the substitutions, insertions, or deletions occur in regions outside the HVRs (i.e., in the FRs). Optionally, the anti-myostatin antibody comprises the VL sequence in SEQ ID NO: 15, 31, 35-38, 96-98, or 99, including post-translational modifications of that sequence. In a particular embodiment, the VL comprises one, two or three HVRs selected from (a) a HVR-L1 comprising the amino acid sequence of SEQ ID NO: 65-69, 122-124, or 129; (b) a HVR-L2 comprising the amino acid sequence of SEQ ID NO: 70-72, 125, or 130; and (c) a HVR-L3 comprising the amino acid sequence of SEQ ID NO: 73, 74, or 131. In some embodiments, the antibody further comprises the variant Fc region amino acid sequence of SEQ ID NO: 229-380, or 381.

In another aspect, an anti-myostatin antibody is provided, wherein the antibody comprises a VL having at least 90%, 91%, 92%, 93%, 94%, 95%, 96%, 97%, 98%, 99%, or 100% sequence identity to the amino acid sequence of SEQ ID NO: 15, 31, 35, 36, 37, or 38. In certain embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 15, 31, 35, 36, 37, or 38. In certain embodiments, the substitutions, insertions, or deletions occur in regions outside the HVRs (i.e., in the FRs). Optionally, the anti-myostatin antibody comprises the VL sequence in SEQ ID NO: 15, 31, 35, 36, 37, or 38, including post-translational modifications of that sequence. In a particular embodiment, the VL comprises one, two or three HVRs selected from (a) a HVR-L1 comprising the amino acid sequence of SEQ ID NO: 65, 66, 67, 68, or 69; (b) a HVR-L2 comprising the amino acid sequence of SEQ ID NO: 70, 71, or 72; and (c) a HVR-L3 comprising the amino acid sequence of SEQ ID NO: 73 or 74. In some embodiments, the antibody further comprises the variant Fc region amino acid sequence of SEQ ID NO: 229-380, or 381.

In another aspect, an anti-myostatin antibody is provided, wherein the antibody comprises a VL having at least 90%, 91%, 92%, 93%, 94%, 95%, 96%, 97%, 98%, 99%, or 100% sequence identity to the amino acid sequence of SEQ ID NO:96-98, or 99. In certain embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO:96-98, or 99. In certain embodiments, the substitutions, insertions, or deletions occur in regions outside the HVRs. Optionally, the anti-myostatin antibody comprises the VL sequence in SEQ ID NO:96-98, or 99, including post-translational modifications of that sequence. In a particular embodiment, the VL comprises one, two or three HVRs selected from (a) a HVR-L1 comprising the amino acid sequence of SEQ ID NO: 122, 123, or 124, 129; (b) a HVR-L2 comprising the amino acid sequence of SEQ ID NO: 125 or 130; and (c) a HVR-L3 comprising the amino acid sequence of SEQ ID NO: 131.

In another aspect, an anti-myostatin antibody is provided, wherein the antibody comprises a VL having at least 90%, 91%, 92%, 93%, 94%, 95%, 96%, 97%, 98%, 99%, or 100% sequence identity to the amino acid sequence of SEQ ID NO: 96. In certain embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 96. In certain embodiments, the substitutions, insertions, or deletions occur in regions outside the HVRs. Optionally, the anti-myostatin antibody comprises the VL sequence in SEQ ID NO: 96, including post-translational modifications of that sequence. In a particular embodiment, the VL comprises one, two or three HVRs selected from (a) a HVR-L1 comprising the amino acid sequence of SEQ ID NO: 122; (b) a HVR-L2 comprising the amino acid sequence of SEQ ID NO: 71; and (c) a HVR-L3 comprising the amino acid sequence of SEQ ID NO: 74. In some embodiments, the antibody further comprises the variant Fc region amino acid sequence of SEQ ID NO: 229-380, or 381.

In another aspect, an anti-myostatin antibody is provided, wherein the antibody comprises a VL having at least 90%, 91%, 92%, 93%, 94%, 95%, 96%, 97%, 98%, 99%, or 100% sequence identity to the amino acid sequence of SEQ ID NO: 97. In certain embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 97. In certain embodiments, the substitutions, insertions, or deletions occur in regions outside the HVRs. Optionally, the anti-myostatin antibody comprises the VL sequence in SEQ ID NO: 97, including post-translational modifications of that sequence. In a particular embodiment, the VL comprises one, two or three HVRs selected from (a) a HVR-L1 comprising the amino acid sequence of SEQ ID NO: 123; (b) a HVR-L2 comprising the amino acid sequence of SEQ ID NO: 71; and (c) a HVR-L3 comprising the amino acid sequence of SEQ ID NO: 74. In some embodiments, the antibody further comprises the variant Fc region amino acid sequence of SEQ ID NO: 229-380, or 381.

In another aspect, an anti-myostatin antibody is provided, wherein the antibody comprises a VH as in any of the embodiments provided above, and a VL as in any of the embodiments provided above. In one embodiment, the antibody comprises the VH and VL sequences in SEQ ID NO: 13, 16-30, 32-34, 86-94, or 95 and SEQ ID NO:15, 31, 35-38, 96-98, or 99, respectively, including post-translational modifications of those sequences. In one embodiment, the antibody comprises the VH and VL sequences in SEQ ID NO: 13, 16-30, 32-34, 86-94, or 95 and SEQ ID NO: 15, 31, 35-38, 96-98, or 99, respectively, including post-translational modifications of those sequences. In one embodiment, the antibody comprises the VH and VL sequences in SEQ ID NO: 86-94, or 95 and SEQ ID NO:96-98, or 99, respectively, including post-translational modifications of those sequences. In some embodiments, the antibody further comprises the variant Fc region amino acid sequence of SEQ ID NO: 229-380, or 381.

In another aspect, an anti-myostatin antibody is provided, wherein the antibody comprises a VH as in any of the embodiments provided above, and a VL as in any of the embodiments provided above. In one embodiment, the antibody comprises the VH and VL sequences in SEQ ID NO: 13, 16-30, 32, 33, or 34 and SEQ ID NO:15, 31, 35-37, or 38, respectively, including post-translational modifications of those sequences. In one embodiment, the antibody comprises the VH and VL sequences in SEQ ID NO: 13, 16-30, 32, 33, or 34 and SEQ ID NO: 15, 31, 35-37, or 38, respectively, including post-translational modifications of those sequences. In some embodiments, the antibody further comprises the variant Fc region amino acid sequence of SEQ ID NO: 229-380, or 381.

In another aspect, an anti-myostatin antibody is provided, wherein the antibody comprises a VH as in any of the embodiments provided above, and a VL as in any of the embodiments provided above. In one embodiment, the antibody comprises the VH and VL sequences in SEQ ID NO: 86-94, or 95 and SEQ ID NO:96-98, or 99, respectively, including post-translational modifications of those sequences. In one embodiment, the antibody comprises the VH and VL sequences in SEQ ID NO: 86-94, or 95 and SEQ ID NO:96-98, or 99, respectively, including post-translational modifications of those sequences. In another aspect, an anti-myostatin antibody is provided, wherein the antibody comprises a VH as in any of the embodiments provided above, and a VL as in any of the embodiments provided above. In one embodiment, the antibody comprises the VH and VL sequences in SEQ ID NO: 86 and SEQ ID NO: 96, respectively, including post-translational modifications of those sequences. In one embodiment, the antibody comprises the VH and VL sequences in SEQ ID NO: 92 and SEQ ID NO: 97, respectively, including post-translational modifications of those sequences.

In another aspect, an anti-myostatin antibody comprises a VH sequence having at least 90%, 91%, 92%, 93%, 94%, 95%, 96%, 97%, 98%, 99%, or 100% sequence identity to the amino acid sequence of SEQ ID NO:12, 145-149, or 150.

In certain embodiments, a VH sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO:12, 145-149, or 150. In certain embodiments, substitutions, insertions, or deletions occur in regions outside the HVRs (i.e., in the FRs). Optionally, the anti-myostatin antibody comprises the VH sequence in SEQ ID NO: 12, 145-149, or 150, including post-translational modifications of that sequence. In a particular embodiment, the VH comprises one, two or three HVRs selected from: (a) a HVR-H1 comprising the amino acid sequence of SEQ ID NO:55, 157-161, or 162, (b) a HVR-H2 comprising the amino acid sequence of SEQ ID NO:55, 58, 163-167, or 168, and (c) a HVR-H3 comprising the amino acid sequence of SEQ ID NO: 61, 169-173, or 174.

In another aspect, an anti-myostatin antibody is provided, wherein the antibody comprises a light chain variable domain (VL) having at least 90%, 91%, 92%, 93%, 94%, 95%, 96%, 97%, 98%, 99%, or 100% sequence identity to the amino acid sequence of SEQ ID NO: 14, 151-155, or 156. In certain embodiments, a VL sequence having at least 90%, 91%, 92%, 93%, 94%, 95%, 96%, 97%, 98%, or 99% identity contains substitutions (e.g., conservative substitutions), insertions, or deletions relative to the reference sequence, but an anti-myostatin antibody comprising that sequence retains the ability to bind to myostatin. In certain embodiments, a total of 1 to 10 amino acids have been substituted, inserted and/or deleted in SEQ ID NO: 14, 151-155, or 156. In certain embodiments, the substitutions, insertions, or deletions occur in regions outside the HVRs (i.e., in the FRs). Optionally, the anti-myostatin antibody comprises the VL sequence in SEQ ID NO: 14, 151-155, or 156, including post-translational modifications of that sequence. In a particular embodiment, the VL comprises one, two or three HVRs selected from (a) a HVR-L1 comprising the amino acid sequence of SEQ ID NO: 65, 175-179, or 180; (b) a HVR-L2 comprising the amino acid sequence of SEQ ID NO: 70, 181-185, or 186; and (c) a HVR-L3 comprising the amino acid sequence of SEQ ID NO: 73, 187-191, or 192.

In another aspect, an anti-myostatin antibody is provided, wherein the antibody comprises a VH as in any of the embodiments provided above, and a VL as in any of the embodiments provided above. In one embodiment, the antibody comprises the VH and VL sequences in SEQ ID NO:12, 145-149, or 150 and SEQ ID NO: 14, 151-155, or 156, respectively, including post-translational modifications of those sequences.

In certain embodiments, an anti-myostatin antibody of the present invention comprises a VH as in any of the embodiments provided above and a heavy chain constant region comprising the amino acid sequence of SEQ ID NO: 7, 9, 11, 193, 195-198, 227, 228, 229-380 or 381. In certain embodiments, an anti-myostatin antibody of the present invention comprises a VL as in any of the embodiments provided above, and a light chain constant region comprising the amino acid sequence of SEQ ID NO: 8 or 10.

In a further aspect, the invention provides an antibody that binds to the same epitope as an anti-myostatin antibody provided herein. In a further aspect, the invention provides an antibody that binds to the same epitope as an antibody described in Table 2a. In a further aspect, the invention provides an antibody that binds to the same epitope as an antibody described in Tables 11a or 13. In certain embodiments, an antibody is provided that binds to an epitope within a fragment of myostatin propeptide consisting of amino acids 21-100 of SEQ ID NO: 78. Alternatively, the antibody binds a myostatin propeptide fragment consisting of amino acids 21-80, 41-100, 21-60, 41-80, 61-100, 21-40, 41-60, 61-80, or 81-100, of SEQ ID NO: 78.

In a further aspect of the invention, an anti-myostatin antibody according to any of the above embodiments is a monoclonal antibody, including a chimeric, humanized or human antibody. In one embodiment, an anti-myostatin antibody is an antibody fragment, e.g., a Fv, Fab, Fab', scFv, diabody, or F(ab')$_2$ fragment. In another embodiment, the antibody is a full length IgG antibody, e.g., an intact IgG1 or IgG4 antibody or other antibody class or isotype as defined herein.

In a further aspect, an anti-myostatin antibody according to any of the above embodiments may incorporate any of the features, singly or in combination, as described in Sections 1-7 below.

In a further aspect, an anti-myostatin antibody according to any of the above embodiments may incorporate an Fc variant region described in Section 8 below. In a further aspect, the anti-myostatin antibody comprises the amino acid sequence of SEQ ID NO: 229-380, or 381. In a further aspect, an anti-myostatin antibody according to any of the above embodiments may incorporate any of the features, singly or in combination, as described in Sections 1-8 below.

1. Antibody Affinity

In certain embodiments, an antibody provided herein has a dissociation constant (Kd) of ≤1 M, ≤100 nM, ≤10 nM, ≤1 nM, ≤0.1 nM, ≤0.01 nM, or ≤0.001 nM (e.g., $10^{-8}$ M or less, e.g., from $10^{-8}$ M to $10^{-13}$ M, e.g., from $10^{-9}$ M to $10^{-13}$ M).

In one embodiment, Kd is measured by a radiolabeled antigen binding assay (RIA). In one embodiment, an RIA is performed with the Fab version of an antibody of interest and its antigen. For example, solution binding affinity of Fabs for antigen is measured by equilibrating Fab with a minimal concentration of ($^{125}$I)-labeled antigen in the presence of a titration series of unlabeled antigen, then capturing bound antigen with an anti-Fab antibody-coated plate (see, e.g., Chen et al., *J. Mol. Biol.* 293:865-881 (1999), which is herein incorporated by reference in its entirety). To establish conditions for the assay, MICROTITER® multi-well plates (Thermo Scientific) are coated overnight with 5 μg/ml of a capturing anti-Fab antibody (Cappel Labs) in 50 mM sodium carbonate (pH9.6), and subsequently blocked with 2% (w/v) bovine serum albumin in PBS for two to five hours at room temperature (approximately 23° C.). In a non-adsorbent plate (Nunc #269620), 100 pM or 26 pM [$^{125}$I]-antigen are mixed with serial dilutions of a Fab of interest (e.g., consistent with assessment of the anti-VEGF antibody, Fab-12, in Presta et al., *Cancer Res.* 57:4593-4599 (1997)). The Fab of interest is then incubated overnight; however, the incubation may continue for a longer period (e.g., about 65 hours) to ensure that equilibrium is reached. Thereafter, the mixtures are transferred to the capture plate for incubation at room temperature (e.g., for one hour). The solution is then removed and the plate washed eight times with 0.1% polysorbate 20 (TWEEN-20®) in PBS. When the plates have dried, 150 μl/well of scintillant (MICROSCINT-20™; Packard) is added, and the plates are counted on a TOP-COUNT™ M gamma counter (Packard) for ten minutes. Concentrations of each Fab that give less than or equal to 20% of maximal binding are chosen for use in competitive binding assays.

According to another embodiment, Kd is measured using a BIACORE® surface plasmon resonance assay. For example, an assay using a BIACORE®-2000 or a BIACORE®-3000 (BIACORE®, Inc., Piscataway, N.J.) is performed at 25° C. with immobilized antigen CM5 chips at ~10 response units (RU). In one embodiment, carboxymethylated dextran biosensor chips (CM5, BIACORE®, Inc.) are activated with N-ethyl-N'-(3-dimethylaminopropyl)-carbodiimide hydrochloride (EDC) and N-hydroxysuccinimide (NHS) according to the supplier's instructions. Antigen is diluted with 10 mM sodium acetate, pH4.8, to 5 μg/ml (~0.2 μM) before injection at a flow rate of 5 μl/minute to achieve approximately 10 response units (RU) of coupled protein. Following the injection of antigen, 1 M ethanolamine is injected to block unreacted groups. For kinetic measurements, two-fold serial dilutions of Fab (0.78 nM to 500 nM) are injected in PBS with 0.05% polysorbate 20 (TWEEN-20™) surfactant (PBST) at 25° C. at a flow rate of approximately 25 μl/min. Association rates ($k_{on}$) and dissociation rates ($k_{off}$) are calculated using a simple one-to-one Langmuir binding model (BIACORE® Evaluation Software version 3.2) by simultaneously fitting the association and dissociation sensorgrams. The equilibrium dissociation constant (Kd) is calculated as the ratio $k_{off}/k_{on}$. See, e.g., Chen et al., *J. Mol. Biol.* 293:865-881 (1999). If the on-rate exceeds $10^6$ $M^{-1}$ $s^{-1}$ by the surface plasmon resonance assay above, then the on-rate can be determined using a fluorescent quenching technique that measures the increase or decrease in fluorescence emission intensity (excitation=295 nm; emission=340 nm, 16 nm band-pass) at 25° C. of a 20 nM anti-antigen antibody (Fab form) in PBS, pH7.2, in the presence of increasing concentrations of antigen as measured in a spectrometer, such as a stop-flow equipped spectrophotometer (Aviv Instruments) or a 8000-series SLM-AMINCO™ spectrophotometer (ThermoSpectronic) with a stirred cuvette.

2. Antibody Fragments

In certain embodiments, an antibody provided herein is an antibody fragment. Antibody fragments include, but are not limited to, Fab, Fab', Fab'-SH, F(ab')$_2$, Fv, and scFv fragments, and other fragments described below. For a review of certain antibody fragments, see Hudson et al. *Nat. Med.* 9:129-134 (2003). For a review of scFv fragments, see, e.g., Pluckthün, in *The Pharmacology of Monoclonal Antibodies*, vol. 113, Rosenburg and Moore eds., (Springer-Verlag, New York), pp. 269-315 (1994); see also, WO 1993/16185; and U.S. Pat. Nos. 5,571,894 and 5,587,458. For discussion of Fab and F(ab')$_2$ fragments comprising salvage receptor binding epitope residues and having increased in vivo half-life, see U.S. Pat. No. 5,869,046. The contents of each of the above publications is herein incorporated by reference in its entirety.

Diabodies are antibody fragments with two antigen-binding sites that may be bivalent or bispecific. See, for example, EP 404,097; WO 1993/01161; Hudson et al., *Nat. Med.* 9:129-134 (2003); and Hollinger et al., *Proc. Natl. Acad. Sci. USA* 90:6444-6448 (1993). Triabodies and tetrabodies are also described in Hudson et al., *Nat. Med.* 9:129-134 (2003).

Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, Mass.; see, e.g., U.S. Pat. No. 6,248,516.

Antibody fragments can be made by various techniques, including but not limited to proteolytic digestion of an intact antibody as well as production by recombinant host cells (e.g., *E. coli* or phage), as described herein.

3. Chimeric and Humanized Antibodies

In certain embodiments, an antibody provided herein is a chimeric antibody. Certain chimeric antibodies are described, e.g., in U.S. Pat. No. 4,816,567; and Morrison et al., *Proc. Natl. Acad. Sci. USA* 81:6851-6855 (1984), each of which is herein incorporated by reference in its entirety). In one example, a chimeric antibody comprises a non-human variable region (e.g., a variable region derived from a mouse, rat, hamster, rabbit, or non-human primate, such as a monkey) and a human constant region. In a further example, a chimeric antibody is a "class switched" antibody in which the class or subclass has been changed from that of the parent antibody. Chimeric antibodies include antigen-binding fragments thereof.

In certain embodiments, a chimeric antibody is a humanized antibody. Typically, a non-human antibody is humanized to reduce immunogenicity to humans, while retaining the specificity and affinity of the parental non-human antibody. Generally, a humanized antibody comprises one or more variable domains in which HVRs, e.g., CDRs, (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the HVR residues are derived), e.g., to restore or improve antibody specificity or affinity.

Humanized antibodies and methods of making them are reviewed, e.g., in Almagro, *Front. Biosci.* 13:1619-1633 (2008), and are further described, e.g., in Riechmann et al., *Nature* 332:323-329 (1988); Queen et al., *Proc. Nat'l Acad. Sci. USA* 86:10029-10033 (1989); U.S. Pat. Nos. 5,821,337, 7,527,791, 6,982,321, and 7,087,409; Kashmiri et al., *Methods* 36:25-34 (2005) (describing specificity determining region (SDR) grafting); Padlan, *Mol. Immunol.* 28:489-498 (1991) (describing "resurfacing"); Dall'Acqua et al., *Methods* 36:43-60 (2005) (describing "FR shuffling"); and Osbourn et al., *Methods* 36:61-68 (2005) and Klimka et al., *Br. J. Cancer,* 83:252-260 (2000) (describing the "guided selection" approach to FR shuffling), the contents of each of which is herein incorporated by reference in its entirety.

Human framework regions that may be used for humanization include but are not limited to: framework regions selected using the "best-fit" method (see, e.g., Sims et al. *J. Immunol.* 151:2296 (1993)); framework regions derived from the consensus sequence of human antibodies of a particular subgroup of light or heavy chain variable regions (see, e.g., Carter et al., *Proc. Natl. Acad. Sci. USA* 89:4285 (1992); and Presta et al. *J. Immunol.* 151:2623 (1993)); human mature (somatically mutated) framework regions or human germline framework regions (see, e.g., Almagro and Fransson, *Front. Biosci.* 13:1619-1633 (2008)); and framework regions derived from screening FR libraries (see, e.g., Baca et al., *J. Biol. Chem.* 272:10678-10684 (1997) and Rosok et al., *J. Biol. Chem.* 271:22611-22618 (1996)), each of which is herein incorporated by reference in its entirety.

4. Human Antibodies

In certain embodiments, an antibody provided herein is a human antibody. Human antibodies can be produced using various techniques known in the art. Human antibodies are described generally in van Dijk and van de Winkel, *Curr. Opin. Pharmacol.* 5:368-374 (2001) and Lonberg, *Curr. Opin. Immunol.* 20:450-459 (2008).

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic mice, the endogenous immunoglobulin loci have generally been inactivated. For review of methods for obtaining human antibodies from transgenic animals, see Lonberg, *Nat. Biotech.* 23:1117-1125 (2005). See also, e.g., U.S. Pat. Nos. 6,075,181 and 6,150,584 describing XENO-MOUSE™ technology; U.S. Pat. No. 5,770,429 describing HUMAB® technology; U.S. Pat. No. 7,041,870 describing K-M MOUSE® technology, and US Patent Application Publication No. US 2007/0061900, describing VELOCI-MOUSE® technology). Human variable regions from intact antibodies generated by such animals may be further modified, e.g., by combining with a different human constant region.

Human antibodies can also be made by hybridoma-based methods. Human myeloma and mouse-human heteromyeloma cell lines for the production of human monoclonal antibodies have been described. (See, e.g., Kozbor *J. Immunol.,* 133:3001 (1984); Brodeur et al., *Monoclonal Antibody Production Techniques and Applications,* pp. 51-63 (Marcel Dekker, Inc., New York, 1987); and Boerner et al., *J. Immunol.* 147:86 (1991).) Human antibodies generated via human B-cell hybridoma technology are also described in Li et al., *Proc. Natl. Acad. Sci. USA* 103:3557-3562 (2006). Additional methods include those described, for example, in U.S. Pat. No. 7,189,826 (describing production of monoclonal human IgM antibodies from hybridoma cell lines) and Ni, *Xiandai Mianyixue* 26(4):265-268 (2006) (describing human-human hybridomas). Human hybridoma technology (Trioma technology) is also described in Vollmers and Brandlein, *Histology and Histopathology* 20(3):927-937 (2005) and Vollmers and Brandlein, *Methods and Findings in Experimental and Findings in Experimental and Clinical Pharmacology* 27(3):185-191 (2005).

Human antibodies may also be generated by isolating Fv clone variable domain sequences selected from human-derived phage display libraries. Such variable domain sequences may then be combined with a desired human constant domain. Techniques for selecting human antibodies from antibody libraries are described below.

5. Library-Derived Antibodies

Antibodies of the invention may be isolated by screening combinatorial libraries for antibodies with the desired activity or activities. For example, a variety of methods are known in the an for generating phage display libraries and screening such libraries for antibodies possessing the desired binding characteristics. Such methods are reviewed, e.g., in Hoogenboom et al. in *Methods in Molecular Biology* 178: 1-37 (2000); O'Brien et al., ed., Human Press, Totowa, N.J., 2001) and further described, e.g., in the McCafferty et al., *Nature* 348:552-554; Clackson et al., *Nature* 352:624-628 (1991); Marks et al., *J. Mol. Biol.* 222:581-597 (1992); Marks and Bradbury, in *Methods in Molecular Biology* 248:161-175 (Lo, ed., Human Press, Totowa, N.J., 2003); Sidhu et al., *J. Mol. Biol.* 338(2):299-310 (2004); Lee et al., *J. Mol. Biol.* 340(5):1073-1093 (2004); Fellouse, *Proc. Natl. Acad. Sci. USA* 101(34):12467-12472 (2004); and Lee et al., *J. Immunol. Methods* 284(1-2): 119-132 (2004).

In certain phage display methods, repertoires of VH and VL genes are separately cloned by polymerase chain reaction (PCR) and recombined randomly in phage libraries, which can then be screened for antigen-binding phage as described in Winter et al., *Ann. Rev. Immunol.* 12:433-455 (1994). Phage typically display antibody fragments, either as single-chain Fv (scFv) fragments or as Fab fragments. Libraries from immunized sources provide high-affinity antibodies to the immunogen without the requirement of constructing hybridomas. Alternatively, the naive repertoire can be cloned (e.g., from human) to provide a single source of antibodies to a wide range of non-self and also self antigens without any immunization as described by Griffiths et al., *EMBO J*, 12:725-734 (1993). Finally, naive libraries can also be made synthetically by cloning unrearranged V-gene segments from stem cells, and using PCR primers containing random sequence to encode the highly variable CDR3 regions and to accomplish rearrangement in vitro, as described by Hoogenboom and Winter, *J. Mol. Biol.* 227: 381-388 (1992). Patent publications describing human antibody phage libraries include, for example: U.S. Pat. No. 5,750,373, and US Publ. Nos. 2005/0079574, 2005/0119455, 2005/0266000, 2007/0117126, 2007/0160598, 2007/0237764, 2007/0292936, and 2009/0002360.

Antibodies or antibody fragments isolated from human antibody libraries are considered human antibodies or human antibody fragments herein.

6. Multispecific Antibodies

In certain embodiments, an antibody provided herein is a multispecific antibody, e.g., a bispecific antibody. Multispecific antibodies are monoclonal antibodies that have binding specificities for at least two different sites. In certain embodiments, one of the binding specificities is for myostatin and the other is for any other antigen. In certain embodiments, bispecific antibodies may bind to two different epitopes of myostatin. Bispecific antibodies may also be used to localize cytotoxic agents to cells which express myostatin. Bispecific antibodies can be prepared as full length antibodies or antibody fragments.

Techniques for making multispecific antibodies include, but are not limited to, recombinant co-expression of two immunoglobulin heavy chain-light chain pairs having different specificities (see, Milstein and Cuello, *Nature* 305: 537 (1983)), WO 1993/08829, and Traunecker et al., *EMBO J.* 10: 3655 (1991)), and "knob-in-hole" engineering (see, e.g., U.S. Pat. No. 5,731,168). Multi-specific antibodies may also be made by engineering electrostatic steering effects for making antibody Fc-heterodimeric molecules (WO 2009/089004A1); cross-linking two or more antibodies or fragments (see, e.g., U.S. Pat. No. 4,676,980, and Brennan et al., *Science,* 229:81 (1985)); using leucine zippers to produce bi-specific antibodies (see, e.g., Kostelny et al., *J. Immunol.* 148(5):1547-1553 (1992)); using "diabody" technology for making bispecific antibody fragments (see, e.g., Hollinger et al., *Proc. Natl. Acad. Sci. USA* 90:6444-6448 (1993)); and using single-chain Fv (sFv) dimers (see, e.g., Gruber et al., *J. Immunol.* 152:5368 (1994)); and preparing trispecific antibodies as described, e.g., in Tutt et al., *J. Immunol.* 147:60 (1991).

Engineered antibodies with three or more functional antigen binding sites, including "Octopus antibodies," are also included herein (see, e.g., US 2006/0025576A1).

The antibody or fragment herein also includes a "Dual Acting FAb" or "DAF" comprising an antigen binding site that binds to myostatin as well as another, different antigen (see, US 2008/0069820, for example).

7. Antibody Variants

In certain embodiments, amino acid sequence variants of the antibodies provided herein are contemplated. For example, it may be desirable to improve the binding affinity and/or other biological properties of the antibody. Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding.

a. Substitution, Insertion, and Deletion Variants

In certain embodiments, antibody variants having one or more amino acid substitutions are provided. Sites of interest for substitutional mutagenesis include the HVRs and FRs. Conservative substitutions are shown in Table 1 under the heading of "preferred substitutions." More substantial changes are provided in Table 1 under the heading of "exemplary substitutions," and as further described below in reference to amino acid side chain classes. Amino acid substitutions may be introduced into an antibody of interest and the products screened for a desired activity, e.g., retained/improved antigen binding, decreased immunogenicity, or improved ADCC or CDC.

TABLE 1

| Original Residue | Exemplary Substitutions | Preferred Substitution |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties: (1) hydrophobic: Norleucine, Met, Ala, Val, Leu, lie; (2) neutral hydrophilic: Cys, Ser, Thr, Asn, Gln; (3) acidic: Asp, Glu; (4) basic: His, Lys, Arg; (5) residues that influence chain orientation: Gly, Pro; and (6) aromatic: Trp, Tyr, Phe. Non-conservative substitutions will entail exchanging a member of one of these groups for a member of another group.

One type of substitutional variant involves substituting one or more hypervariable region residues of a parent antibody (e.g., a humanized or human antibody). Generally, the resulting variant(s) selected for further study will have modifications (e.g., improvements) in certain biological properties (e.g., increased affinity, reduced immunogenicity) relative to the parent antibody and/or will have substantially retained certain biological properties of the parent antibody. An exemplary substitutional variant is an affinity matured antibody, which may be conveniently generated, e.g., using phage display-based affinity maturation techniques such as those described herein. Briefly, one or more HVR residues are mutated and the variant antibodies displayed on phage and screened for a particular biological activity (e.g., binding affinity).

Alterations (e.g., substitutions) may be made in HVRs, e.g., to improve antibody affinity. Such alterations may be made in HVR "hotspots," i.e., residues encoded by codons that undergo mutation at high frequency during the somatic maturation process (see, e.g., Chowdhury, *Methods Mol. Biol.* 207:179-196 (2008)), and/or residues that contact antigen, with the resulting variant VH or VL being tested for binding affinity. Affinity maturation by constructing and reselecting from secondary libraries has been described, e.g., in Hoogenboom et al. in *Methods in Molecular Biology* 178:1-37 (O'Brien et al., ed., Human Press, Totowa, N.J., (2001).) In some embodiments of affinity maturation, diversity is introduced into the variable genes chosen for maturation by any of a variety of methods (e.g., error-prone PCR, chain shuffling, or oligonucleotide-directed mutagenesis). A secondary library is then created. The library is then screened to identify any antibody variants with the desired affinity. Another method to introduce diversity involves HVR-directed approaches, in which several HVR residues (e.g., 4-6 residues at a time) are randomized. HVR residues involved in antigen binding may be specifically identified, e.g., using alanine scanning mutagenesis or modeling. CDR-H3 and CDR-L3 in particular are often targeted.

In certain embodiments, substitutions, insertions, or deletions may occur within one or more HVRs so long as such alterations do not substantially reduce the ability of the antibody to bind antigen. For example, conservative alterations (e.g., conservative substitutions as provided herein) that do not substantially reduce binding affinity may be made in HVRs. Such alterations may, for example, be outside of antigen contacting residues in the HVRs. In certain embodiments of the variant VH and VL sequences provided above, each HVR either is unaltered, or contains no more than one, two or three amino acid substitutions.

A useful method for identification of residues or regions of an antibody that may be targeted for mutagenesis is called "alanine scanning mutagenesis" as described by Cunningham and Wells, *Science* 244:1081-1085 (1989). In this method, a residue or group of target residues (e.g., charged residues such as arg, asp, his, lys, and glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antibody complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme (e.g., for ADEPT) or a polypeptide which increases the serum half-life of the antibody.

b. Glycosylation Variants

In certain embodiments, an antibody provided herein is altered to increase or decrease the extent to which the antibody is glycosylated. Addition or deletion of glycosylation sites to an antibody may be conveniently accomplished by altering the amino acid sequence such that one or more glycosylation sites is created or removed.

Where the antibody comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al., *TIBTECH* 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in an antibody of the invention may be made in order to create antibody variants with certain improved properties.

In one embodiment, antibody variants are provided having a carbohydrate structure that lacks fucose attached (directly or indirectly) to an Fc region. For example, the amount of fucose in such antibody may be from 1% to 80%, from 1% to 65%, from 5% to 65% or from 20% to 40%. The amount of fucose is determined by calculating the average amount of fucose within the sugar chain at Asn297, relative to the sum of all glycostructures attached to Asn 297 (e.g. complex, hybrid and high mannose structures) as measured by MALDI-TOF mass spectrometry, as described in WO 2008/077546, for example. Asn297 refers to the asparagine residue located at about position 297 in the Fc region (Eu numbering of Fc region residues); however, Asn297 may also be located about ±3 amino acids upstream or downstream of position 297, i.e., between positions 294 and 300, due to minor sequence variations in antibodies. Such fucosylation variants may have improved ADCC function. See, e.g., US Publ. Nos. US 2003/0157108 (Presta, L.); US 2004/0093621 (Kyowa Hakko Kogyo Co., Ltd). Examples of publications related to "defucosylated" or "fucose-deficient" antibody variants include: US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO 2005/053742; WO 2002/031140; Okazaki et al., *J. Mol. Biol.* 336:1239-1249 (2004); Yamane-Ohnuki et al., *Biotech. Bioeng.* 87:614 (2004). Examples of cell lines capable of producing defucosylated antibodies include Lec13 CHO cells deficient in protein fucosylation (Ripka et al., *Arch. Biochem. Biophys.* 249:533-545 (1986); US Pat Appl No US 2003/0157108 A1, Presta, L; and WO 2004/056312, Adams et al., especially at Example 11), and knockout cell lines, such as alpha-1,6-fucosyltransferase gene, FUT8, knockout CHO cells (see, e.g., Yamane-Ohnuki et al., *Biotech. Bioeng.* 87:614 (2004); Kanda et al., *Biotechnol. Bioeng.* 94(4):680-688 (2006); and WO 2003/085107).

Antibodies variants are further provided with bisected oligosaccharides, e.g., in which a biantennary oligosaccharide attached to the Fc region of the antibody is bisected by GlcNAc. Such antibody variants may have reduced fucosylation and/or improved ADCC function. Examples of such antibody variants are described, e.g., in WO 2003/011878 (Jean-Mairet et al.); U.S. Pat. No. 6,602,684 (Umana et al.); and US 2005/0123546 (Umana et al.). Antibody variants with at least one galactose residue in the oligosaccharide attached to the Fc region are also provided. Such antibody variants may have improved CDC function. Such antibody variants are described, e.g., in WO 1997/30087 (Patel et al.); WO 1998/58964 (Raju, S.); and WO 1999/22764 (Raju, S.).

c. Fc Region Variants

In certain embodiments, one or more amino acid modifications may be introduced into the Fc region of an antibody provided herein, thereby generating an Fc region variant. The Fc region variant may comprise a human Fc region sequence (e.g., a human IgG1, IgG2, IgG3 or IgG4 Fc region) comprising an amino acid modification (e.g., a substitution) at one or more amino acid positions.

In certain embodiments, the invention contemplates an antibody variant that possesses some but not all effector functions, which make it a desirable candidate for applications in which the half life of the antibody in vivo is important yet certain effector functions (such as complement and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the antibody lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, Annu. Rev. Immunol. 9:457-492 (1991). Non-limiting examples of in vitro assays to assess ADCC activity of a molecule of interest is described in U.S. Pat. No. 5,500,362 (see, e.g., Hellstrom, et al. *Proc. Nat'l Acad. Sci. USA* 83:7059-7063 (1986)) and Hellstrom, I et al., *Proc. Natl Acad. Sci. USA* 82:1499-1502 (1985); U.S. Pat. No. 5,821,337 (see Bruggemann, et al., *J. Exp. Med.* 166:1351-1361 (1987)). Alternatively, non-radioactive assays methods may be employed (see, for example, ACTI™ non-radioactive cytotoxicity assay for flow cytometry (CellTechnology, Inc. Mountain View, Calif.); and CytoTox 96® non-radioactive cytotoxicity assay (Promega, Madison, Wis.)). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. *Proc. Nat'l Acad. Sci. USA* 95:652-656 (1998). C1q binding assays may also be carried out to confirm that the antibody is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg et al., *Blood* 101:1045-1052 (2003); and Cragg, *Blood* 103:2738-2743 (2004)). FcRn binding and in vivo clearance/half life determinations can also be performed using methods known in the art (see, e.g., Petkova et al., *Int'l. Immunol.* 18(12):I759-I769 (2006)).

Antibodies with reduced effector function include those with substitution of one or more of Fc region residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581).

Certain antibody variants with improved or diminished binding to FcRs are described. (See, e.g., U.S. Pat. No. 6,737,056; WO 2004/056312, and Shields et al., *J. Biol. Chem.* 9(2): 6591-6604 (2001).)

In certain embodiments, an antibody variant comprises an Fc region with one or more amino acid substitutions which improve ADCC, e.g., substitutions at positions 298, 333, and/or 334 of the Fc region (EU numbering of residues).

In some embodiments, alterations are made in the Fc region that result in altered (i.e., either improved or diminished) C1q binding and/or Complement Dependent Cytotoxicity (CDC), e.g., as described in U.S. Pat. No. 6,194,551, WO 1999/51642, and Idusogie et al., *J. Immunol.* 164:4178-4184 (2000).

Antibodies with increased half lives and improved binding to the neonatal Fc receptor (FcRn), which is responsible for the transfer of maternal IgGs to the fetus (Guyer et al., *J. Immunol.* 117:587 (1976) and Kim et al., *J. Immunol.* 24:249 (1994)), are described in US2005/0014934A1 (Hinton et al.). Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826). See also, Duncan, *Nature* 322:738-40 (1988); U.S. Pat. Nos. 5,648, 260 and 5,624,821; and WO 1994/29351 concerning other examples of Fc region variants.

d. Cysteine Engineered Antibody Variants

In certain embodiments, it may be desirable to create cysteine engineered antibodies, e.g., "thioMAbs," in which one or more residues of an antibody are substituted with cysteine residues. In particular embodiments, the substituted residues occur at accessible sites of the antibody. By substituting those residues with cysteine, reactive thiol groups are thereby positioned at accessible sites of the antibody and may be used to conjugate the antibody to other moieties, such as drug moieties or linker-drug moieties, to create an immunoconjugate, as described further herein. In certain embodiments, any one or more of the following residues may be substituted with cysteine: V205 (Kabat numbering) of the light chain; A118 (EU numbering) of the heavy chain; and S400 (EU numbering) of the heavy chain Fc region. Cysteine engineered antibodies may be generated as described, e.g., in U.S. Pat. No. 7,521,541.

e. Antibody Derivatives

In certain embodiments, an antibody provided herein may be further modified to contain additional nonproteinaceous moieties that are known in the art and readily available. The moieties suitable for derivatization of the antibody include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone) polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer are attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

In another embodiment, conjugates of an antibody and nonproteinaceous moiety that may be selectively heated by exposure to radiation are provided. In one embodiment, the nonproteinaceous moiety is a carbon nanotube (Kam et al., *Proc. Natl. Acad. Sci. USA* 102:11600-11605 (2005)). The radiation may be of any wavelength, and includes, but is not limited to, wavelengths that do not harm ordinary cells, but which heat the nonproteinaceous moiety to a temperature at which cells proximal to the antibody-nonproteinaceous moiety are killed.

8. Variant Fc Regions

In one aspect, the invention provides an isolated polypeptide comprising a variant Fc region with enhanced FcγRIIb-binding activity. In some aspects, the polypeptide is an antibody. In some aspects, the polypeptide is an Fc fusion protein. In certain embodiments, the variant Fc region comprises at least one amino acid residue alteration (e.g., substitution) compared to the corresponding sequence in the Fc region of a native or reference variant sequence (sometimes collectively referred to herein as a "parent" Fc region). In certain embodiments, the variant Fc region of the invention has enhanced binding activity for monkey FcγRIIb compared to the parent Fc region. In particular embodiments, the monkey FcγRIIb is cynomolgus monkey FcγRIIb (SEQ ID NO: 223).

In certain embodiments, the ratio of [KD value of a parent Fc region for monkey FcγRIIb]/[KD value of a variant Fc region for monkey FcγRIIb] can be 2.0 or greater, 3.0 or greater, 4.0 or greater, 5.0 or greater, 6.0 or greater, 7.0 or greater, 8.0 or greater, 9.0 or greater, 10 or greater, 15 or greater, 20 or greater, 25 or greater, 30 or greater, 40 or greater, or 50 or greater. In further embodiments, the variant Fc region has decreased binding activity for monkey FcγRIIIa. In certain embodiments, the ratio of [KD value of a parent Fc region for monkey FcγRIIIa]/[KD value of a variant Fc region for monkey FcγRIIIa] can be 0.50 or smaller, 0.40 or smaller, 0.30 or smaller, 0.20 or smaller, 0.10 or smaller, 0.09 or smaller, 0.08 or smaller, 0.07 or smaller, 0.06 or smaller, 0.05 or smaller, 0.04 or smaller, 0.03 or smaller, 0.02 or smaller, or 0.01 or smaller. In certain embodiments, the monkey FcγRIIb has the sequence of SEQ ID NO:223 (cynomolgous monkey). In certain embodiments, the monkey FcγRIIIa has the sequence of SEQ ID NO:224 (cynomolgous monkey).

In further embodiments, the variant Fc region has enhanced binding activity for human FcγRIIb. In certain embodiments, the ratio of [KD value of a parent Fc region for human FcγRIIb]/[KD value of a variant Fc region for human FcγRIIb] can be 2.0 or greater, 3.0 or greater, 4.0 or greater, 5.0 or greater, 6.0 or greater, 7.0 or greater, 8.0 or greater, 9.0 or greater, 10 or greater, 15 or greater, 20 or greater, 25 or greater, 30 or greater, 40 or greater, or 50 or greater. In further embodiments, the variant Fc region has decreased binding activity for human FcγRIIIa. In certain embodiments, the ratio of [KD value of a parent Fc region for human FcγRIIIa]/[KD value of a variant Fc region for human FcγRIIIa] can be 0.50 or smaller, 0.40 or smaller, 0.30 or smaller, 0.20 or smaller, 0.10 or smaller, 0.09 or smaller, 0.08 or smaller, 0.07 or smaller, 0.06 or smaller, 0.05 or smaller, 0.04 or smaller, 0.03 or smaller, 0.02 or smaller, or 0.01 or smaller. In certain embodiments, the human FcγRIIb has the sequence of SEQ ID NO:212, 213, or 214. In certain embodiments, the human FcγRIIIa has the sequence of SEQ ID NO:215, 216, 217, or 218.

In further embodiments, the variant Fc region has decreased binding activity for human FcγRIIa (type H). In certain embodiments, the ratio of [KD value of a parent Fc region for human FcγRIIa (type H)]/[KD value of a variant Fc region for human FcγRIIa (type H)] can be 5.0 or smaller, 4.0 or smaller, 3.0 or smaller, 2.0 or smaller, 1.0 or smaller, 0.9 or smaller, 0.8 or smaller, 0.7 or smaller, 0.6 or smaller, 0.5 or smaller, 0.4 or smaller, 0.3 or smaller, 0.2 or smaller, or 0.1 or smaller. In further embodiments, the variant Fc region has decreased binding activity for human FcγRIIa (type R). In certain embodiments, the ratio of [KD value of a parent Fc region for human FcγRIIa (type R)]/[KD value of a variant Fc region for human FcγRIIa (type R)] can be 5.0 or smaller, 4.0 or smaller, 3.0 or smaller, 2.0 or smaller, 1.0 or smaller, 0.9 or smaller, 0.8 or smaller, 0.7 or smaller, 0.6 or smaller, 0.5 or smaller, 0.4 or smaller, 0.3 or smaller, 0.2 or smaller, or 0.1 or smaller. In certain embodiments, the human FcγRIIa (type H) has the sequence of SEQ ID NO:211. In certain embodiments, the human FcγRIIa (type R) has the sequence of SEQ ID NO:210.

In certain embodiments, the ratio of [KD value of a parent Fc region for monkey FcγRIIa]/[KD value of a variant Fc region for monkey FcγRIIa] can be 2.0 or greater, 3.0 or greater, 4.0 or greater, 5.0 or greater, 6.0 or greater, 7.0 or greater, 8.0 or greater, 9.0 or greater, 10 or greater, 15 or greater, 20 or greater, 25 or greater, 30 or greater, 40 or greater, or 50 or greater. In certain embodiments, monkey FcγRIIa is selected from monkey FcγRIIa1 (e.g., cynomolgous FcγRIIa1 (SEQ ID NO:220)), monkey FcγRIIa2 (e.g., cynomolgous FcγRIIa2 (SEQ ID NO:221)), and monkey FcγRIIa3 (e.g., cynomolgous FcγRIIa3 (SEQ ID NO:222).

In another embodiment, the KD value of the variant Fc region for monkey FcγRIIb can be $1.0 \times 10^{-6}$ M or smaller, $9.0 \times 10^{-7}$ M or smaller, $8.0 \times 10^{-7}$ M or smaller, $7.0 \times 10^{-7}$ M or smaller, $6.0 \times 10^{-7}$ M or smaller, $5.0 \times 10^{-7}$ M or smaller, $4.0 \times 10^{-7}$ M or smaller, $3.0 \times 10^{-7}$ M or smaller, $2.0 \times 10^{-7}$ M or smaller, or $1.0 \times 10^{-7}$ M or smaller. In another embodiment, the KD value of the variant Fc region for monkey FcγRIIIa can be $5.0 \times 10^{-7}$ M or greater, $6.0 \times 10^{-7}$ M or greater, $7.0 \times 10^{-7}$ M or greater, $8.0 \times 10^{-7}$ M or greater, $9.0 \times 10^{-7}$ M or greater, $1.0 \times 10^{-6}$ M or greater, $2.0 \times 10^{-6}$ M or greater, $3.0 \times 10^{-6}$ M or greater, $4.0 \times 10^{-6}$ M or greater, $5.0 \times 10^{-6}$ M or greater, $6.0 \times 10^{-6}$ M or greater, $7.0 \times 10^{-6}$ M or greater, $8.0 \times 10^{-6}$ M or greater, $9.0 \times 10^{-6}$ M or greater, or $1.0 \times 10^{-5}$ M or greater. In another embodiment, the KD value of the variant Fc region for human FcγRIIb can be $2.0 \times 10^{-6}$ M or smaller, $1.0 \times 10^{-6}$ M or smaller, $9.0 \times 10^{-7}$ M or smaller, $8.0 \times 10^{-7}$ M or smaller, $7.0 \times 10^{-7}$ M or smaller, $6.0 \times 10^{-7}$ M or smaller, $5.0 \times 10^{-7}$ M or smaller, $4.0 \times 10^{-7}$ M or smaller, $3.0 \times 10^{-7}$ M or smaller, $2.0 \times 10^{-7}$ M or smaller, or $1.0 \times 10^{-7}$ M or smaller. In another embodiment, the KD value of the variant Fc region for human FcγRIIIa can be $1.0 \times 10^{-6}$ M or greater, $2.0 \times 10^{-6}$ M or greater, $3.0 \times 10^{-6}$ M or greater, $4.0 \times 10^{-6}$ M or greater, $5.0 \times 10^{-6}$ M or greater, $6.0 \times 10^{-6}$ M or greater, $7.0 \times 10^{-6}$ M or greater, $8.0 \times 10^{-6}$ M or greater, $9.0 \times 10^{-6}$ M or greater, $1.0 \times 10^{-5}$ M or greater, $2.0 \times 10^{-5}$ M or greater, $3.0 \times 10^{-5}$ M or greater, $4.0 \times 10^{-5}$ M or greater, or $5.0 \times 10^{-5}$ M or greater. In another embodiment, the KD value of the variant Fc region for human FcγRIIa (type H) can be $1.0 \times 10^{-7}$ M or greater, $2.0 \times 10^{-7}$ M or greater, $3.0 \times 10^{-7}$ M or greater, $4.0 \times 10^{-7}$ M or greater, $5.0 \times 10^{-7}$ M or greater, $6.0 \times 10^{-7}$ M or greater, $7.0 \times 10^{-7}$ M or greater, $8.0 \times 10^{-7}$ M or greater, $9.0 \times 10^{-7}$ M or greater, $1.0 \times 10^{-6}$ M or greater, $2.0 \times 10^{-6}$ M or greater, $3.0 \times 10^{-6}$ M or greater, $4.0 \times 10^{-6}$ M or greater, or $5.0 \times 10^{-6}$ M or greater. In another embodiment, the KD value of the variant Fc region for human FcγRIIa (type R) can be $2.0 \times 10^{-7}$ M or greater, $3.0 \times 10^{-7}$ M or greater, $4.0 \times 10^{-7}$ M or greater, $5.0 \times 10^{-7}$ M or greater, $6.0 \times 10^{-7}$ M or greater, $7.0 \times 10^{-7}$ M or greater, $8.0 \times 10^{-7}$ M or greater, $9.0 \times 10^{-7}$ M or greater, $1.0 \times 10^{-6}$ M or greater, $2.0 \times 10^{-6}$ M or greater, $3.0 \times 10^{-6}$ M or greater, $4.0 \times 10^{-6}$ M or greater, or $5.0 \times 10^{-6}$ M or greater.

In another embodiment, the KD value of the variant Fc region for monkey FcγRIIa can be $1.0 \times 10^{-6}$ M or smaller, $9.0 \times 10^{-7}$ M or smaller, $8.0 \times 10^{-7}$ M or smaller, $7.0 \times 10^{-7}$ M or smaller, $6.0 \times 10^{-7}$ M or smaller, $5.0 \times 10^{-7}$ M or smaller, $4.0 \times 10^{-7}$ M or smaller, $3.0 \times 10^{-7}$ M or smaller, $2.0 \times 10^{-7}$ M or smaller, or $1.0 \times 10^{-7}$ M or smaller. In certain embodiments, monkey FcγRIIa can be selected from any one of monkey FcγRIIa1, monkey FcγRIIa2, and monkey FcγRIIa3.

When we develop a pharmaceutical product for the treatment of human diseases, evaluation of its efficacy and safety in monkey are important because of its biological proximity to human. From such viewpoints, a pharmaceutical product to be developed is preferable to have cross-reactivity to both human and monkey in the target binding activity.

"Fcγ receptors" (herein, referred to as Fcγ receptors, FcγR or FcgR) refers to receptors that may bind to the Fc region of IgG1, IgG2, IgG3, and IgG4 monoclonal antibodies, and practically means any member of the family of proteins encoded by the Fcγ receptor genes. In humans, this family includes FcγRI (CD64) including isoforms FcγRIa, FcγRIb, and FcγRIc; FcγRII (CD32) including isoforms FcγRIIa (including allotypes H131 (type H) and R131 (type R)), FcγRIIb (including FcγRIIb-1 and FcγRIIb-2), and FcγRIIc; and FcγRIII (CD16) including isoforms FcγRIIIa (including allotypes V158 and F158), and FcγRIIIb (including allotypes FcγRIIIb-NA1 and FcγRIIIb-NA2), and any human FcγRs, FcγR isoforms or allotypes yet to be discovered, but is not limited thereto. FcγRIIb and FcγRIIb2 have been reported as splicing variants of human FcγRIIb. In addition, a splicing variant named FcγRIIb3 has been reported (J Exp Med, 1989, 170: 1369-1385). In addition to these splicing variants, human FcγRIIb includes all splicing variants registered in NCBI, which are NP_001002273.1, NP_001002274.1, NP_001002275.1, NP_001177757.1, and NP_003992.3. Furthermore, human FcγRIIb includes every previously-reported genetic polymorphism, as well as FcγRIIb (*Arthritis Rheum.* 48:3242-3252 (2003); Kono et al., *Hum. Mol. Genet.* 14:2881-2892 (2005); and Kyogoju et al., *Arthritis Rheum.* 46:1242-1254 (2002)), and every genetic polymorphism that will be reported in the future.

In FcγRIIa, there are two allotypes, one where the amino acid at position 131 of FcγRIIa is histidine (type H) and the other where the amino acid at position 131 is substituted with arginine (type R) (Warrmerdam, J. Exp. Med. 172:19-25 (1990)).

The FcγR includes human, mouse, rat, rabbit, and monkey-derived FcγRs but is not limited thereto, and may be derived from any organism. Mouse FcγRs include FcγRI (CD64), FcγRII (CD32), FcγRIII (CD16), and FcγRIII-2 (CD16-2), and any mouse FcγRs, or FcγR isoforms, but are not limited thereto. Unless otherwise specified, the term "monkey FcγR" or variation thereof, refers to cynomolgous FcγRIIa1 (SEQ ID NO:220), FcγRIIa2 (SEQ ID NO:221), FcγRIIa3 (SEQ ID NO:222), FcγRIIb (SEQ ID NO:223), or FcγRIIIaS (SEQ ID NO:224).

The polynucleotide sequence of human FcγRI is set forth in SEQ ID NO: 199 (NM_000566.3); the polynucleotide sequence of human FcγRIIa is set forth in SEQ ID NO: 200 (BC020823.1) or SEQ ID NO:201 (NM_001136219.1); the polynucleotide sequence of human FcγRIIb is set forth in SEQ ID NO: 202 (BC146678.1) or SEQ ID NO:203 (NM_004001.3); the polynucleotide sequence of human FcγRIIIa is set forth in SEQ ID NO: 204 (BC033678.1) or SEQ ID NO:205 (NM_001127593.1); and the polynucleotide sequence of human FcγRIIIb is set forth in SEQ ID NO: 206 (BC128562.1).

The amino acid sequence of human FcγRI is set forth in SEQ ID NO: 207 (NP_000557.1); the amino acid sequence of human FcγRIIa is set forth in SEQ ID NO: 208 (AAH20823.1), SEQ ID NO:209, SEQ ID NO:210 or SEQ ID NO:211; the amino acid sequence of human FcγRIIb is set forth in SEQ ID NO: 212 (AAI46679.1), SEQ ID NO: 213 or SEQ ID NO:214; the amino acid sequence of human FcγRIIIa is set forth in SEQ ID NO: 215 (AAH33678.1), SEQ ID NO:216, SEQ ID NO:217 or SEQ ID NO:218; and the amino acid sequence of human FcγRIIIb is set forth in SEQ ID NO: 219 (AAI28563.1).

The amino acid sequence of cynomolgus monkey FcγRIIa is set forth in SEQ ID NO: 220 (FcγRIIa1), SEQ ID NO:221 (FcγRIIa2) or SEQ ID NO:222 (FcγRIIa3); the amino acid sequence of cynomolgus FcγRIIb is set forth in SEQ ID NO: 223; and the amino acid sequence of cynomolgus monkey FcγRIIIa is set forth in SEQ ID NO: 224.

In one aspect, the invention provides polypeptides containing variant Fc regions with enhanced FcγRIIb-binding activity compared to a corresponding reference FcγRIb-binding polypeptide. In further aspects, the polypeptide of the invention comprises at least one amino acid alteration of at least one position selected from the group consisting of: 231, 232, 233, 234, 235, 236, 237, 238, 239, 264, 266, 267, 268, 271, 295, 298, 325, 326, 327, 328, 330, 331, 332, 334, and 396, according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In one aspect, the invention provides polypeptides comprising variant Fc regions with enhanced FcγRIIb-binding activity comprising at least two amino acid alterations comprising: (a) one amino acid alteration at position 236, and (b) at least one amino acid alteration of at least one position selected from the group consisting of: 231, 232, 233, 234, 235, 237, 238, 239, 264, 266, 267, 268, 271, 295, 298, 325, 326, 327, 328, 330, 331, 332, 334, and 396, according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In one aspect, the invention provides polypeptides comprising a variant Fc region with enhanced FcγRIIb-binding activity comprising an amino acid alteration at position 236 according to EU numbering.

In one aspect, the invention provides polypeptides comprising a variant Fc region with enhanced FcγRIIb-binding activity comprising at least two amino acid alterations comprising: (a) one amino acid alteration at position 236, and (b) at least one amino acid alteration of at least one position selected from the group consisting of: 231, 232, 235, 239, 268, 295, 298, 326, 330, and 396, according to EU numbering. In a further embodiment, the variant Fc region comprises an amino acid alteration of at least one position selected from the group consisting of: 231, 232, 235, 239, 268, 295, 298, 326, 330, and 396, according to EU numbering. In a further embodiment, the variant Fc region comprises an amino acid alteration of at least one position selected from the group consisting of: 268, 295, 326, and 330, according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In another aspect, the invention provides polypeptides comprising variant Fc regions with enhanced FcγRIIb-binding activity comprising amino acid alterations of any one of the following (1)-(37): (1) positions 231, 236, 239, 268 and 330; (2) positions 231, 236, 239, 268, 295 and 330; (3) positions 231, 236, 268 and 330; (4) positions 231, 236, 268, 295 and 330; (5) positions 232, 236, 239, 268, 295 and 330; (6) positions 232, 236, 268, 295 and 330; (7) positions 232, 236, 268 and 330; (8) positions 235, 236, 268, 295, 326 and 330; (9) positions 235, 236, 268, 295 and 330; (10) positions 235, 236, 268 and 330; (11) positions 235, 236, 268, 330 and 396; (12) positions 235, 236, 268 and 396; (13) positions 236, 239, 268, 295, 298 and 330; (14) positions 236, 239, 268, 295, 326 and 330; (15) positions 236, 239, 268, 295 and 330; (16) positions 236, 239, 268, 298 and 330; (17) positions 236, 239, 268, 326 and 330; (18) positions 236, 239, 268 and 330; (19) positions 236, 239, 268, 330 and 396; (20) positions 236, 239, 268 and 396; (21) positions 236 and 268; (22) positions 236, 268 and 295; (23) positions 236, 268, 295, 298 and 330; (24) positions 236, 268, 295, 326 and 330; (25) positions 236, 268, 295, 326, 330 and 396; (26) positions 236, 268, 295 and 330; (27) positions 236, 268, 295, 330 and 396; (28) positions 236, 268, 298 and 330; (29) positions 236, 268, 298 and 396; (30) positions 236, 268, 326 and 330; (31) positions 236, 268, 326, 330 and 396; (32) positions 236, 268 and 330; (33) positions 236, 268, 330 and 396; (34) positions 236, 268 and 396; (35) positions 236 and 295; (36) positions 236, 330 and 396; and (37) positions 236 and 396, according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In a further embodiment, the variant Fc region with enhanced FcγRIIb-binding activity comprises at least one amino acid selected from the group consisting of: (a) Asp, Glu, Phe, Gly, His, Ile, Lys, Leu, Met, Asn, Pro, Gln, Arg, Ser, Thr, Val, Trp, Tyr at position 231; (b) Ala, Asp, Glu, Phe, Gly, His, Ile, Lys, Leu, Met, Asn, Gln, Arg, Ser, Thr, Val, Trp, Tyr at position 232; (c) Asp at position 233; (d) Trp, Tyr at position 234; (e) Trp at position 235; (f) Ala, Asp, Glu, His, Ile, Leu, Met, Asn, Gln, Ser, Thr, Val at position 236; (g) Asp, Tyr at position 237; (h) Glu, Ile, Met, Gln, Tyr at position 238; (i) Ile, Leu, Asn, Pro, Val at position 239; (j) Ile at position 264; (k) Phe at position 266; (l) Ala, His, Leu at position 267; (m) Asp, Glu at position 268; (n) Asp, Glu, Gly at position 271; (o) Leu at position 295; (p) Leu at position 298; (q) Glu, Phe, Ile, Leu at position 325; (r) Thr at position 326; (s) Ile, Asn at position 327; (t) Thr at position 328; (u) Lys, Arg at position 330; (v) Glu at position 331; (w) Asp at position 332; (x) Asp, Ile, Met, Val, Tyr at position 334; and (y) Ala, Asp, Glu, Phe, Gly, His, Ile, Lys, Leu, Met, Asn, Gln, Arg, Ser, Thr, Val, Trp, Tyr at position 396; according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In a further embodiment, the variant Fc region with enhanced FcγRIIb-binding activity comprises at least one amino acid alteration (e.g., substitution) selected from the group consisting of: (a) Gly, Thr at position 231; (b) Asp at position 232; (c) Trp at position 235; (d) Asn, Thr at position 236; (e) Val at position 239; (f) Asp, Glu at position 268; (g) Leu at position 295; (h) Leu at position 298; (i) Thr at position 326; (j) Lys, Arg at position 330; and (k) Lys, Met at position 396; according to EU numbering. In a further embodiment, the variant Fc region with enhanced FcγRIIb-binding activity comprises amino acid alterations (e.g., substitutions) of: Asn at position 236, Glu at position 268, Lys at position 330, and Met at position 396; according to EU numbering. In a further embodiment, the variant Fc region with enhanced FcγRIIb-binding activity comprises amino acid alterations (e.g., substitutions) of: Asn at position 236, Asp at position 268, and Lys at position 330; according to EU numbering. In a further embodiment, the variant Fc region with enhanced FcγRIIb-binding activity comprises amino acid alterations (e.g., substitutions) of: Asn at position 236, Asp at position 268, Leu at position 295, and Lys at position 330; according to EU numbering. In a further embodiment, the variant Fc region with enhanced FcγRIIb-binding activity comprises amino acid alterations (e.g., substitutions) of: Thr at position 236, Asp at position 268, and Lys at position 330; according to EU numbering. In a further embodiment, the variant Fc region with enhanced FcγRIIb-binding activity comprises amino acid alterations (e.g., substitutions) of Asn at position 236, Asp at position 268, Leu at position 295, Thr at position 326, and Lys at position 330; according to EU numbering. In a further embodiment, the variant Fc region with enhanced FcγRIIb-binding activity comprises amino acid alterations (e.g., substitutions) of: Trp at position 235, Asn at position 236, Asp at position 268, Leu at position 295, Thr at position 326, and Lys at position 330; according to EU numbering.

In one aspect, the invention provides polypeptides comprising variant Fc regions with enhanced FcγRIIb-binding activity comprising an amino acid alteration at position 238 according to EU numbering.

In one aspect, the invention provides polypeptides comprising variant Fc regions with enhanced FcγRIIb-binding activity comprising at least one amino acid alteration of at least one position selected from the group consisting of: 234, 238, 250, 264, 267, 307, and 330 according to EU numbering. In further embodiments, the polypeptide comprises at least one amino acid alteration of at least one position selected from the group consisting of: 234, 250, 264, 267, 307, and 330 according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In another aspect, the invention provides polypeptides comprising variant Fc regions with enhanced FcγRIIb-binding activity comprising amino acid alterations of any one of the following (1)-(9): (1) positions 234, 238, 250, 307 and 330; (2) positions 234, 238, 250, 264, 307 and 330; (3) positions 234, 238, 250, 264, 267, 307 and 330; (4) positions 234, 238, 250, 267, 307 and 330; (5) positions 238, 250, 264, 307 and 330; (6) positions 238, 250, 264, 267, 307 and 330; (7) positions 238, 250, 267, 307 and 330; (8) positions 238, 250 and 307; and (9) positions 238, 250, 307 and 330, according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In a further embodiment, the variant Fc region with enhanced FcγRIIb-binding activity comprises at least one amino acid alteration (e.g., substitution) selected from the group consisting of: (a) Tyr at position 234; (b) Asp at position 238; (c) Val at position 250, (d) Ile at position 264; (e) Ala at position 267; (f) Pro at position 307; and (g) Lys at position 330; according to EU numbering. In a further embodiment, the variant Fc region with enhanced FcγRIIb-binding activity comprises amino acid alterations (e.g., substitutions) of: Asp at position 238; according to EU numbering. In a further embodiment, the variant Fc region with enhanced FcγRIIb-binding activity comprises amino acid alterations (e.g., substitutions) of: Asp at position 238, Val at position 250, and Pro at position 307; according to EU numbering. In a further embodiment, the variant Fc region with enhanced FcγRIIb-binding activity comprises amino acid alterations (e.g., substitutions) of: Asp at position 238, Val at position 250, Pro at position 307, and Lys at position 330; according to EU numbering. In a further embodiment, the variant Fc region with enhanced FcγRIIb-binding activity comprises amino acid alterations (e.g., substitutions) of: Asp at position 238, Val at position 250, Ile at position 264, Pro at position 307, and Lys at position 330; according to EU numbering. In a further embodiment, the variant Fc region with enhanced FcγRIIb-binding activity comprises amino acid alterations (e.g., substitutions) of: Asp at position 238, Val at position 250, Ala at position 267, Pro at position 307, and Lys at position 330; according to EU numbering. In a further embodiment, the variant Fc region with enhanced FcγRIIb-binding activity comprises amino acid alterations (e.g., substitutions) of: Tyr at position 234, Asp at position 238, Val at position 250, Pro at position 307, and Lys at position 330; according to EU numbering. In a further embodiment, the variant Fc region with enhanced FcγRIIb-binding activity comprises amino acid alterations (e.g., substitutions) of: Tyr at position 234, Asp at position 238, Val at position 250, Ala at position 267, Pro at position 307, and Lys at position 330; according to EU numbering. In a further embodiment, the variant Fc region with enhanced FcγRIIb-binding activity comprises amino acid alterations (e.g., substitutions) of: Asp at position 238, Val at position 250, Ile at position 264, Ala at position 267, Pro at position 307, and Lys at position 330; according to EU numbering. In a further embodiment, the variant Fc region with enhanced FcγRIIb-binding activity comprises amino acid alterations (e.g., substitutions) of: Tyr at position 234, Asp at position 238, Val at position 250, Ile at position 264, Pro at position 307, and Lys at position 330; according to EU numbering. In a further embodiment, the variant Fc region with enhanced FcγRIIb-binding activity comprises amino acid alterations (e.g., substitutions) of: Tyr at position 234, Asp at position 238, Val at position 250, lie at position 264, Ala at position 267, Pro at position 307, and Lys at position 330; according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In another aspect, the invention provides isolated polypeptides comprising variant Fc regions with increased isoelectric point (pI). In certain embodiments, a variant Fc region described herein comprises at least two amino acid alterations in a parent Fc region. In certain embodiments, each of the amino acid alterations increases the isoelectric point (pI) of the variant Fc region compared with that of the parent Fc region. They are based on the findings that antigen elimination from plasma can be promoted with an antibody whose pI has been increased by modification of at least two amino acid residues, for example when the antibody is administered in vivo.

In the present invention, pI may be either a theoretical or an experimentally determined pI. The value of pI can be determined, for example, by isoelectric focusing known to those skilled in the art. The value of a theoretical pI can be calculated, for example, using gene and amino acid sequence analysis software (Genetyx, etc.).

In one embodiment, the pI value may be increased, for example, at least by 0.01, 0.03, 0.05, 0.1, 0.2, 0.3, 0.4, 0.5, or more, at least by 0.6, 0.7, 0.8, 0.9, or more, at least by 1.0, 1.1, 1.2, 1.3, 1.4, 1.5, or more, or at least by 1.6, 1.7, 1.8, 1.9, 2.0, 2.1, 2.2, 2.3, 2.4, 2.5, 3.0 or more, as compared to before modification.

In certain embodiments, the amino acid for increased pI can be exposed on the surface of the variant Fc region. In the present invention, an amino acid that can be exposed on the surface generally refers to an amino acid residue located on the surface of a polypeptide constituting a variant Fc region. An amino acid residue located on the surface of a polypeptide refers to an amino acid residue whose side chain can be in contact with solvent molecules (which in general are mostly water molecules). However, the side chain does not necessarily have to be wholly in contact with solvent molecules, and when even a portion of the side chain is in contact with the solvent molecules, the amino acid is defined as an "amino acid residue located on the surface". The amino acid residues located on the surface of a polypeptide also include amino acid residues located close to the surface and thereby can have an electric charge influence from another amino acid residue whose side chain, even partly, is in contact with the solvent molecules. Those skilled in the art can prepare a homology model of a polypeptide for example, using commercially available softwares. Alternatively, it is possible to use methods known to those skilled in the art, such as X-ray crystallography. The amino acid residues that can be exposed on the surface are determined, for example, using coordinates from a three-dimensional model using a computer program such as InsightII program (Accelrys). Surface-exposable sites may be determined using algorithms known in the technical field (for example, Lee and Richards (*J. Mol. Biol.* 55:379-400 (1971)); Connolly (*J. Appl. Cryst.* 16:548-558 (1983)). Surface-exposable sites can be determined using software suitable for protein modeling and three-dimensional structure information. Software available for such purposes includes, for example, the SYBYL Biopolymer Module software (Tripos Associates). When an algorithm requires a user input size parameter, the "size" of a probe which is used in the calculation may be set to about 1.4 Angstrom (Å) or less in radius. Furthermore, methods for determining surface-exposable regions using software for personal computers have been described by Pacios (*Comput. Chem.* 18(4):377-386 (1994); *J. Mol. Model.* 1:46-53 (1995)). Based on such information as described above, appropriate amino acid residues located on the surface of a polypeptide that constitutes a variant Fc region can be selected.

In certain embodiments, a polypeptide comprises both the variant Fc region and an antigen-binding domain. In further embodiments, the antigen is a soluble antigen. In one embodiment, the antigen is present in biological fluids (for example, plasma, interstitial fluid, lymphatic fluid, ascitic fluid, and pleural fluid) of subjects. The antigen may also be a membrane antigen.

In further embodiments, antigen-binding activity of the antigen-binding domain changes according to ion concentration conditions. In one embodiment, ion concentration is not particularly limited and refers to hydrogen ion concentration (pH) or metal ion concentration. Herein, metal ions refer to ions of group I elements except hydrogen, such as alkaline metals and the copper group elements, group II elements such as alkaline earth metals and zinc group elements, group III elements except boron, group 1V elements except carbon and silicon, group VIII elements such as iron group and platinum group elements, elements belonging to subgroup A of groups V, VI, and VII, and metal elements such as antimony, bismuth, and polonium. In the present invention, metal ions include, for example, calcium ion, as described in WO 2012/073992 and WO 2013/125667. In one embodiment, "ion concentration condition" may be a condition that focuses on differences in the biological behavior of an antigen-binding domain between a low ion concentration and a high ion concentration. Furthermore, "antigen-binding activity of an antigen-binding domain changes according to ion concentration conditions" means that the antigen-binding activity of an antigen-binding domain changes between a low ion concentration and a high ion concentration (such an antigen-binding domain is referred to herein as "ion concentration-dependent antigen-binding domain"). The antigen-binding activity of an antigen-binding domain under a high ion concentration condition may be higher (stronger) or lower (weaker) than that under a low ion concentration condition. In one embodiment, ion concentration-dependent antigen-binding domains (such as pH-dependent antigen-binding domains or calcium ion concentration-dependent antigen-binding domains) can be obtained by known methods, for example, described in WO 2009/125825, WO 2012/073992, and WO 2013/046722.

In the present invention, the antigen-binding activity of an antigen-binding domain under a high calcium ion concentration condition may be higher than under a low calcium ion concentration condition. The high calcium ion concentration is not particularly limited to but may be a concentration selected between 100 μM and 10 mM, between 200 μM and 5 mM, between 400 μM and 3 mM, between 200 μM and 2 mM, between 400 μM and 1 mM, or between 500 μM and 2.5 mM, which is preferable to be close to the plasma (blood) concentration of calcium ion in vivo. Meanwhile, the low calcium ion concentration is not particularly limited to but may be a concentration selected between 0.1 μM and 30 μM, between 0.2 μM and 20 μM, between 0.5 μM and 10 μM, between 1 μM and 5 μM, or between 2 μM and 4 μM, which is preferable to be close to the concentration of calcium ion in early endosomes in vivo.

In one embodiment, the ratio between the antigen-binding activities under a low calcium ion concentration condition and a high calcium ion concentration condition is not limited but the ratio of the dissociation constant (KD) under a low calcium ion concentration condition to the KD under a high calcium ion concentration condition, i.e., KD (low calcium ion concentration condition)/KD (high calcium ion concentration condition), is 2 or more, 10 or more, or 40 or more. The upper limit of the ratio may be 400, 1000, or 10000, as long as such an antigen-binding domain can be produced by techniques known to those skilled in the art. Alternatively, for example, the dissociation rate constant (kd) can be used instead of the KD. In this case, the ratio of the kd under a low calcium ion concentration condition to the kd under a high calcium ion concentration condition, i.e., kd (low calcium ion concentration condition)/kd (high calcium ion concentration condition), is 2 or more, 5 or more, 10 or more, or 30 or more. The upper limit of the ratio may be 50, 100, or 200, as long as the antigen-binding domain can be produced based on the common technical knowledge of those skilled in the art.

In the present invention, the antigen-binding activity of an antigen-binding domain under a low hydrogen ion concentration (neutral pH) may be higher than under a high hydrogen ion concentration (acidic pH). The acidic pH may be, for example, a pH selected from pH4.0 to pH6.5, selected from pH4.5 to pH6.5, selected from pH5.0 to pH6.5, or selected from pH5.5 to pH6.5, which is preferable to be close to the in vivo pH in early endosomes. The acidic pH may also be, for example, pH5.8 or pH6.0. In particular embodiments, the acidic pH is pH5.8. Meanwhile, the neutral pH may be, for example, a pH selected from pH6.7 to pH10.0, selected from pH6.7 to pH9.5, selected from pH7.0 to pH9.0, or selected from pH7.0 to pH8.0, which is preferable to be close to the in vivo pH in plasma (blood). The neutral pH may also be, for example, pH7.4 or pH7.0. In particular embodiments, the neutral pH is pH7.4.

In one embodiment, the ratio between the antigen-binding activities under an acidic pH condition and a neutral pH condition is not limited but the ratio of the dissociation constant (KD) under an acidic pH condition to the KD under a neutral pH condition, i.e., KD (acidic pH condition)/KD (neutral pH condition), is 2 or more, 10 or more, or 40 or more. The upper limit of the ratio may be 400, 1000, or 10000, as long as such an antigen-binding domain can be produced by techniques known to those skilled in the art. Alternatively, for example, the dissociation rate constant (kd) can be used instead of the KD. In this case, the ratio of the kd under an acidic pH condition to the kd under a neutral pH condition, i.e., kd (acidic pH condition)/kd (neutral pH condition) is 2 or more, 5 or more, 10 or more, or 30 or more. The upper limit of the ratio may be 50, 100, or 200, as long as the antigen-binding domain can be produced based on the common technical knowledge of those skilled in the art.

In one embodiment, for example, at least one amino acid residue is substituted with an amino acid residue with a side-chain pKa of 4.0-8.0, and/or at least one amino acid with a side-chain pKa of 4.0-8.0 is inserted in the antigen-binding domain, as described in WO 2009/125825. The amino acid may be substituted and/or inserted at any site as long as the antigen-binding activity of the antigen-binding domain becomes weaker under an acidic pH condition than under a neutral pH condition as compared to before the substitution or insertion. When the antigen-binding domain has a variable region or CDR, the site may be within the variable region or CDR. The number of amino acids that are substituted or inserted can be appropriately determined by those skilled in the art; and the number may be one or more. Amino acids with a side-chain pKa of 4.0-8.0 can be used to change the antigen-binding activity of the antigen-binding domain according to the hydrogen ion concentration condition. Such amino acids include, for example, natural amino acids such as His (H) and Glu (E), and unnatural amino acids such as histidine analogs (US2009/0035836), m-NO2-Tyr (pKa 7.45), 3,5-Br2-Tyr (pKa 7.21), and 3,5-I2-Tyr (pKa 7.38) (Heyl et al., Bioorg. Med. Chem. 11(17):3761-3768 (2003)). Amino acids with a side-chain pKa of 6.0-7.0 can also be used, which include, e.g., His (H).

In another embodiment, preferable antigen-binding domains for the variant Fc region with increased pI are described and can be obtained by methods described in Japanese patent applications JP2015-021371 and JP2015-185254.

In certain embodiments, the variant Fc region with increased pI comprises at least two amino acid alterations of at least two positions selected from the group consisting of:

285, 311, 312, 315, 318, 333, 335, 337, 341, 342, 343, 384, 385, 388, 390, 399, 400, 401, 402, 413, 420, 422, and 431, according to EU numbering.

In further embodiments, the variant Fc region with increased pI comprises at least two amino acid alterations of at least two positions selected from the group consisting of: 311, 341, 343, 384, 399, 400, 401, 402, and 413, according to EU numbering.

In another aspect, the invention provides polypeptides comprising variant Fc regions with increased pI comprising amino acid alterations of any one of the following (1)-(10): (1) positions 311 and 341; (2) positions 311 and 343; (3) positions 311, 343 and 413; (4) positions 311, 384 and 413; (5) positions 311 and 399; (6) positions 311 and 401; (7) positions 311 and 413; (8) positions 400 and 413; (9) positions 401 and 413; and (10) positions 402 and 413; according to EU numbering.

A method for increasing the pI of a protein is, for example, to reduce the number of amino acids with a negatively charged side chain (for example, aspartic acid and glutamic acid) and/or to increase the number of amino acids with a positively charged side chain (for example, arginine, lysine and histidine) at a neutral pH condition. Amino acids with a negatively charged side chain have a negative charge represented as −1 at a pH condition that is sufficiently higher than their side chain pKa, which is a theory well known to those skilled in the art. For example, the theoretical pKa for the side chain of aspartic acid is 3.9, and the side chain has a negative charge represented as −1 at a neutral pH condition (for example, in a solution of pH7.0). Conversely, amino acids with a positively charged side chain have a positive charge represented as +1 at a pH condition that is sufficiently lower than their side chain pKa. For example, the theoretical pKa for the side chain of arginine is 12.5, and the side chain has a positive charge represented as +1 at a neutral pH condition (for example, in a solution of pH7.0). Meanwhile, amino acids whose side chain has no charge at a neutral pH condition (for example, in a solution of pH7.0) are known to include 15 types of natural amino acids, i.e., alanine, cysteine, phenylalanine, glycine, isoleucine, leucine, methionine, asparagine, proline, glutamine, serine, threonine, valine, tryptophan, and tyrosine. As a matter of course, it is understood that amino acids for increasing the pI may be unnatural amino acids.

From the above, a method for increasing the pI of a protein at a neutral pH condition (for example, in a solution of pH7.0) can confer a charge alteration of +1 to a protein of interest, for example, by substituting amino acids with non-charged side chains for aspartic acid or glutamic acid (whose side chain has a negative charge of −1) in the amino acid sequence of the protein. Furthermore, a charge alteration of +1 can be conferred to the protein, for example, by substituting arginine or lysine (whose side chain has a positive charge of +1) for amino acids whose side chain has no charge. Moreover, a charge alteration of +2 can be conferred at a time to the protein by substituting arginine or lysine (whose side chain has a positive charge of +1) for aspartic acid or glutamic acid (whose side chain has a negative charge of −1). Alternatively, to increase the pI of a protein, amino acids with a side chain having no charge and/or preferably amino acids having a positively charged side chain can be added or inserted into the amino acid sequence of the protein, or amino acids with a side chain having no charge and/or preferably amino acids with a negatively charged side chain present in the amino acid sequence of the protein can be deleted. It is understood that, for example, the N-terminal and C-terminal amino acid residues of a protein have a main chain-derived charge ($NH_3^+$ of the amino group at the N-terminus and $COO^-$ of the carbonyl group at the C-terminus) in addition to their side chain-derived charges. Thus, the pI of a protein can also be increased by performing to the main chain-derived functional groups some addition, deletion, substitution, or insertion.

The substitution of an amino acid to increase the pI includes, for example, substitution of an amino acid whose side chain has no charge for an amino acid having a negatively charged side chain, substitution of an amino acid having a positively charged side chain for an amino acid whose side chain has no charge, and substitution of an amino acid having a positively charged side chain for an amino acid having a negatively charged side chain in the amino acid sequence of a parent Fc region, which are performed alone or in appropriate combinations.

The insertion or addition of an amino acid to increase the pI includes, for example, insertion or addition of an amino acid whose side chain has no charge, and/or insertion or addition of an amino acid having a positively charged side chain in the amino acid sequence of a parent Fc region, which are performed alone or in appropriate combinations.

The deletion of an amino acid to increase the pI includes, for example, deletion of an amino acid whose side chain has no charge, and/or deletion of an amino acid having a negatively charged side chain in the amino acid sequence of a parent Fc region, which are performed alone or in appropriate combinations.

In one embodiment, natural amino acids used for increasing pI can be classified as follows: (a) an amino acid with a negatively charged side chain can be Glu (E) or Asp (D); (b) an amino acid whose side chain has no charge can be Ala (A), Asn (N), Cys (C), Gln (Q), Gly (G), His (H), Ile (I), Leu (L), Met (M), Phe (F), Pro (P), Ser (S), Thr (T), Trp (W), Tyr (Y), or Val (V); and (c) an amino acid with a positively charged side chain can be His (H), Lys (K), or Arg (R). In one embodiment, the amino acid insertion or substitution after modification is Lys (K) or Arg (R).

In another aspect, the invention provides isolated polypeptides comprising variant Fc regions with enhanced FcγRIIb-binding activity and increased pI. In certain embodiments, a variant Fc region described herein comprises at least two amino acid alterations in a parent Fc region.

In one aspect, the invention provides polypeptides comprising variant Fc regions with enhanced FcγRIIb-binding activity and increased pI comprising at least three amino acid alterations comprising: (a) at least one amino acid alteration of at least one position selected from the group consisting of: 231, 232, 233, 234, 235, 236, 237, 238, 239, 264, 266, 267, 268, 271, 295, 298, 325, 326, 327, 328, 330, 331, 332, 334, and 396, according to EU numbering, and (b) at least two amino acid alterations of at least two positions selected from the group consisting of: 285, 311, 312, 315, 318, 333, 335, 337, 341, 342, 343, 384, 385, 388, 390, 399, 400, 401, 402, 413, 420, 422, and 431, according to EU numbering.

In one aspect, the invention provides polypeptides comprising variant Fc regions with enhanced FcγRIIb-binding activity and increased pI, and that comprise at least three amino acid alterations comprising: (a) at least one amino acid alteration of at least one position selected from the group consisting of: 231, 232, 235, 236, 239, 268, 295, 298, 326, 330, and 396, according to EU numbering, and (b) at least two amino acid alterations of at least two positions selected from the group consisting of: 311, 341, 343, 384, 399, 400, 401, 402, and 413, according to EU numbering.

In another aspect, the invention provides polypeptides comprising variant Fc regions with enhanced FcγRIIb-binding activity and increased pI comprising amino acid alterations of any one of the following (1)-(9): (1) positions 235, 236, 268, 295, 311, 326, 330 and 343; (2) positions 236, 268, 295, 311, 326, 330 and 343; (3) positions 236, 268, 295, 311, 330 and 413; (4) positions 236, 268, 311, 330, 396 and 399; (5) positions 236, 268, 311, 330 and 343; (6) positions 236, 268, 311, 330, 343 and 413; (7) positions 236, 268, 311, 330, 384 and 413; (8) positions 236, 268, 311, 330 and 413; and (9) positions 236, 268, 330, 396, 400 and 413; according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In one aspect, the invention provides polypeptides comprising variant Fc regions with enhanced FcγRIIb-binding activity and increased pI comprising at least three amino acid alterations comprising: (a) at least one amino acid alteration of at least one position selected from the group consisting of: 234, 238, 250, 264, 267, 307, and 330, and (b) at least two amino acid alterations of at least two positions selected from the group consisting of: 285, 311, 312, 315, 318, 333, 335, 337, 341, 342, 343, 384, 385, 388, 390, 399, 400, 401, 402, 413, 420, 422, and 431, according to EU numbering. In further embodiments, the polypeptides comprise at least two amino acid alterations of at least two positions selected from the group consisting of: 311, 341, 343, 384, 399, 400, 401, 402, and 413, according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In another aspect, the invention provides polypeptides comprising variant Fc regions with enhanced FcγRIIb-binding activity and increased pI comprising amino acid alterations of any one of the following (1)-(16): (1) positions 234, 238, 250, 264, 307, 311, 330 and 343; (2) positions 234, 238, 250, 264, 307, 311, 330 and 413; (3) positions 234, 238, 250, 264, 267, 307, 311, 330 and 343; (4) positions 234, 238, 250, 264, 267, 307, 311, 330 and 413; (5) positions 234, 238, 250, 267, 307, 311, 330 and 343; (6) positions 234, 238, 250, 267, 307, 311, 330 and 413; (7) positions 234, 238, 250, 307, 311, 330 and 343; (8) positions 234, 238, 250, 307, 311, 330 and 413; (9) positions 238, 250, 264, 267, 307, 311, 330 and 343; (10) positions 238, 250, 264, 267, 307, 311, 330 and 413; (11) positions 238, 250, 264, 307, 311, 330 and 343; (12) positions 238, 250, 264, 307, 311, 330 and 413; (13) positions 238, 250, 267, 307, 311, 330 and 343; (14) positions 238, 250, 267, 307, 311, 330 and 413; (15) positions 238, 250, 307, 311, 330 and 343; and (16) positions 238, 250, 307, 311, 330 and 413; according to EU numbering.

In a further embodiment, the variant Fc region comprises amino acid alterations selected from any single alteration, combination of single alterations, or combination alterations described in Tables 14-30.

In some embodiments, a polypeptide comprises a variant Fc region of the present invention. In a further embodiment, the polypeptide is an antibody heavy chain constant region. In a further embodiment, the polypeptide is an antibody heavy chain. In a further embodiment, the polypeptide is an antibody. In a further embodiment, the polypeptide is an Fc fusion protein.

In a further embodiment, the invention provides a polypeptide comprising the amino acid sequence of SEQ ID NO: 229-380, or 381.

A "parent Fc region" as used herein refers to an Fc region prior to introduction of amino acid alteration(s) described herein. Preferred examples of the parent Fc region include Fc regions derived from native antibodies. Antibodies include, for example, IgA (IgA1, IgA2), IgD, IgE, IgG (IgG1, IgG2, IgG3, IgG4), and IgM, or such. Antibodies may be derived from human or monkey (e.g., cynomolgus, rhesus macaque, marmoset, chimpanzee, or baboon). Native antibodies may also include naturally-occurring mutations. A plurality of allotype sequences of IgGs due to genetic polymorphism are described in "Sequences of proteins of immunological interest", NIH Publication No. 91-3242, and any of them may be used in the present invention. In particular, for human IgG1, the amino acid sequence at positions 356 to 358 (EU numbering) may be either DEL or EEM. Preferred examples of the parent Fc region include Fc regions derived from a heavy chain constant region of human IgG1 (SEQ ID NO: 195), human IgG2 (SEQ ID NO: 196), human IgG3 (SEQ ID NO: 197), and human IgG4 (SEQ ID NO: 198). Another preferred example of the parent Fc region is an Fc region derived from a heavy chain constant region SG1 (SEQ ID NO: 9). Furthermore, the parent Fc region may be an Fc region produced by adding an amino acid alteration(s) other than the amino acid alteration(s) described herein to an Fc region derived from a native antibody.

In addition, amino acid alterations performed for other purpose(s) can be combined in a variant Fc region described herein. For example, amino acid substitutions that improve FcRn-binding activity (Hinton et al., J. Immunol. 176(1): 346-356 (2006); Dall'Acqua et al., J. Biol. Chem. 281(33): 23514-23524 (2006); Petkova et al., Intl. Immunol. 18(12): 1759-1769 (2006); Zalevsky et al., Nat. Biotechnol. 28(2): 157-159 (2010); WO 2006/019447; WO 2006/053301; and WO 2009/086320), and amino acid substitutions for improving antibody heterogeneity or stability (WO 2009/041613) may be added. Alternatively, polypeptides with the property of promoting antigen clearance, which are described in WO 2011/122011, WO 2012/132067, WO 2013/046704 or WO 2013/180201, polypeptides with the property of specific binding to a target tissue, which are described in WO 2013/180200, polypeptides with the property for repeated binding to a plurality of antigen molecules, which are described in WO 2009/125825, WO 2012/073992 or WO 2013/047752, can be combined with a variant Fc region described herein. Alternatively, with the objective of conferring binding ability to other antigens, the amino acid alterations disclosed in EP1752471 and EP1772465 may be combined in CH3 of a variant Fc region described herein. Alternatively, with the objective of increasing plasma retention, amino acid alterations that decrease the pI of the constant region (WO 2012/016227) may be combined in a variant Fc region described herein. Alternatively, with the objective of promoting uptake into cells, amino acid alterations that increase the pI of the constant region (WO 2014/145159) may be combined in a variant Fc region described herein. Alternatively, with the objective of promoting elimination of a target molecule from plasma, amino acid alterations that increase the pI of the constant region (Japanese patent application numbers JP2015-021371 and JP2015-185254) may be combined in a variant Fc region described herein. In one embodiment, such alteration may include, for example, substitution at al least one position selected from the group consisting of 311, 343, 384, 399, 400, and 413 according to EU numbering. In a further embodiment, such substitution may be a replacement of an amino acid with Lys or Arg at each position.

Amino acid alterations of enhancing human FcRn-binding activity under acidic pH can also be combined in a variant Fc region described herein. Specifically, such alterations may include, for example, substitution of Leu for Met at position 428 and substitution of Ser for Asn at position 434, according to EU numbering (Zalevsky et al., Nat. Biotechnol. 28:157-159 (2010)); substitution of Ala for Asn at position 434 (Deng et al., Metab. Dispos. 38(4):600-605 (2010)); substitution of Tyr for Met at position 252, substitution of Thr for Ser at position 254 and substitution of Glu for Thr at position 256 (Dall'Acqua et al., J. Biol. Chem. 281:23514-23524 (2006)); substitution of Gln for Thr at position 250 and substitution of Leu for Met at position 428 (Hinton et al., J. Immunol 176(1):346-356 (2006)); substitution of His for Asn at position 434 (Zheng et al., Clin. Pharmacol. Ther. 89(2):283-290 (2011), and alterations described in WO 2010/106180, WO 2010/045193, WO 2009/058492, WO 2008/022152, WO 2006/050166, WO 2006/053301, WO 2006/031370, WO 2005/123780, WO 2005/047327, WO 2005/037867, WO 2004/035752, or WO 2002/060919. Such alterations may include, for example, at least one alteration selected from the group consisting of substitution of Leu for Met at position 428, substitution of Ala for Asn at position 434 and substitution of Thr for Tyr at position 436. Those alterations may further include substitution of Arg for Gin at position 438 and/or substitution of Glu for Ser at position 440 (Japanese patent application numbers JP2015-021371 and JP2015-185254).

Two or more polypeptides comprising a variant Fc region described herein can be included in one molecule, wherein two polypeptides comprising variant Fc regions are associated, much like in an antibody. The type of antibody is not limited, and IgA (IgA1, IgA2), IgD, IgE, IgG (IgG1, IgG2, IgG3, IgG4), and IgM, or such can be used.

The two associated polypeptides comprising variant Fc regions may be polypeptides comprising variant Fc regions into which the same amino acid alteration(s) have been introduced (hereinafter, referred to as homologous variant Fc regions), or polypeptides comprising variant Fc regions into which different amino acid alteration(s) have been introduced, or alternatively polypeptides comprising variant Fc regions where amino acid alteration(s) have been introduced into only one of the Fc regions (hereinafter, referred as a heterologous polypeptides comprising variant Fc regions). One of the preferable amino acid alterations is an alteration in the loop structure from positions 233 to 239 (EU numbering) in the CH2 domain of the Fc region, which is involved in binding with FcγRIIb and FcγRIIa. Preferably, an alteration is introduced in the loop structure of the CH2 domain of one of the Fc regions that enhances FcγRIIb-binding activity and/or selectivity, and another alteration is introduced in the loop structure of the CH2 domain of the other Fc region that destabilizes it. Examples of amino acid alterations that can destabilize the loop structure of the CH2 domain may be substitution of at least one amino acid selected from amino acids at positions 235, 236, 237, 238, and 239 to another amino acid. Specifically, it can be destabilized, for example, by altering the amino acid at position 235 to Asp, Gln, Glu, or Thr, altering the amino acid at position 236 to Asn, altering the amino acid at position 237 to Phe or Trp, altering the amino acid at position 238 to Glu, Gly, or Asn, and altering the amino acid at position 239 to Asp or Glu, according to EU numbering.

For association of heterologous polypeptides comprising variant Fc regions, a technique of suppressing unintended association of homologous polypeptides comprising variant Fc regions by introducing electrostatic repulsion into the interface of the CH2 or CH3 domain of the Fc region can be applied, as described in WO 2006/106905.

Examples of amino acid residues in contact at the interface of the CH2 or CH3 domain of the Fc region include the residue at position 356 (EU numbering), the residue at position 439 (EU numbering), the residue at position 357 (EU numbering), the residue at position 370 (EU numbering), the residue at position 399 (EU numbering), and the residue at position 409 (EU numbering) in the CH3 domain.

More specifically, for example, the Fc region in which one to three pairs of amino acid residues selected from (1) to (3) shown below have the same charge can be produced: (1) amino acid residues at positions 356 and 439 (EU numbering) in the CH3 domain; (2) amino acid residues at positions 357 and 370 (EU numbering) in the CH3 domain; and (3) amino acid residues at positions 399 and 409 (EU numbering) in the CH3 domain.

Furthermore, heterologous polypeptides comprising variant Fc regions can be produced, wherein one to three pairs of amino acid residues selected from (1) to (3) indicated above have the same charge in the CH3 domain of the first Fc region, and the pairs of amino acid residues selected in the aforementioned first Fc region also have the same charge in the CH3 domain of the second Fc region, provided that the charges in the first and second Fc regions are opposite.

In the above-mentioned Fc regions, for example, negatively-charged amino acid residues are preferably selected from glutamic acid (E) and aspartic acid (D), and positively-charged amino acid residues are preferably selected from lysine (K), arginine (R), and histidine (H).

Other known techniques can be used additionally for association of heterologous polypeptides comprising variant Fc regions. Specifically, such a technique is conducted by substituting an amino acid side chain present in one of the Fc regions with a larger side chain (knob; which means "bulge"), and substituting an amino acid side chain present in the Fc region with a smaller side chain (hole; which means "void"), to place the knob within the hole. This can promote efficient association between Fc-region-containing polypeptides having different amino acid sequences from each other (WO 1996/027011; Ridgway et al., Prot. Eng. 9:617-621 (1996); Merchant et al., Nat. Biotech. 16, 677-681 (1998)).

In addition, other known techniques can also be used for heterologous association of polypeptides comprising variant Fc regions. Association of polypeptides comprising an Fc region can be induced efficiently using strand-exchange engineered domain CH3 heterodimers (Davis et al., Prof. Eng. Des. & Sel., 23:195-202 (2010)). This technique can also be used to efficiently induce association between Fc region-containing polypeptides having different amino acid sequences.

In addition, heterodimerized antibody production techniques that use association of antibody CH1 and CL, and association of VH and VL, which are described in WO 2011/028952, can also be used.

As with the method described in WO 2008/119353 and WO 2011/131746, it is also possible to use the technique of producing heterodimerized antibodies by producing two types of homodimerized antibodies in advance, incubating the antibodies under reducing conditions to dissociate them, and allowing them to associate again.

As with the method described in Strop (*J. Mol. Biol.* 420:204-219 (2012)), it is also possible to use the technique of producing heterodimerized antibodies by introducing charged residues such as Lys, Arg, Glu, and Asp so that electrostatic repulsion is introduced into CH3 domains.

Furthermore, as with the method described in WO 2012/058768, it is also possible to use the technique of producing heterodimerized antibodies by adding alterations to the CH2 and CH3 domains.

When simultaneously expressing two polypeptides comprising a variant Fc region which have different amino acid sequences, in order to produce polypeptides comprising heterologous variant Fc regions, polypeptides comprising homologous variant Fc regions are also usually produced as impurities. In such cases, polypeptides comprising heterologous variant Fc regions can be efficiently obtained by separating and purifying them from polypeptides comprising homologous variant Fc regions using known technologies. A method has been reported to efficiently separate and purify heterodimerized antibodies from a homodimerized antibodies using ion exchange chromatography, by introducing amino acid alterations into the variable regions of the two types of antibody heavy chains to create a difference in isoelectric points between the homodimerized antibodies and the heterodimerized antibodies (WO 2007/114325). Another method has been reported to purify heterodimerized antibodies using Protein A chromatography, by constructing a heterodimerized antibody comprising two types of heavy chains derived from mouse IgG2a that binds to Protein A and rat IgG2b that does not bind to Protein A (WO 1998/050431 and WO 1995/033844).

Furthermore, a heterodimerized antibody can be efficiently purified using Protein A chromatography, by substituting amino acid residues at positions 435 and 436 (EU numbering), which are located in the Protein A binding site of an antibody heavy chain, with amino acids such as Tyr or His, to yield different Protein A binding affinities.

In the present invention, amino acid alteration means any of substitution, deletion, addition, insertion, and modification, or a combination thereof. In the present invention, amino acid alteration may be rephrased as amino acid mutation.

When substituting amino acid residues, substitution to a different amino acid residue can be carried out with the objective of altering aspects such as (a)-(c) described below: (a) polypeptide backbone structure in the sheet-structure or helical-structure region; (b) electric charge or hydrophobicity at the target site; or (c) size of the side chain.

Amino acid residues are classified into the following groups based on their general side chain properties: (a) hydrophobic: Norleucine, Met, Ala, Val, Leu, and Ile; (b) neutral hydrophilic: Cys, Ser, Thr, Asn, and Gln; (c) acidic: Asp and Glu; (d) basic: His, Lys, and Arg; (e) residues that affect the chain orientation: Gly and Pro; and (f) aromatic: Trp, Tyr, and Phe.

Amino acid alterations are produced by various methods known to those skilled in the art. Such methods include the site-directed mutagenesis method (Hashimoto-Gotoh et al., *Gene* 152:271-275 (1995); Zoller, *Meth. Enzymol.* 100:468-500 (1983); Kramer et al., *Nucleic Acids Res.* 12: 9441-9456 (1984)); Kramer and Fritz, *Methods Enzymol.* 154: 350-367 (1987); and Kunkel, *Proc. Natl. Acad. Sci. USA* 82:488-492 (1985)), the PCR mutation method, and the cassette mutation method, but are not limited thereto.

The number of amino acid alterations introduced into an Fc region is not limited. In certain embodiments, it can be 1, 2 or less, 3 or less, 4 or less, 5 or less, 6 or less, 8 or less, 10 or less, 12 or less, 14 or less, 16 or less, 18 or less, or 20 or less.

Amino acid modification includes post-translational modification. A specific post-translational modification may be addition or deletion of a sugar chain. For example, the amino acid residue at position 297 (EU numbering) in the IgG1 constant region may be sugar chain-modified. The sugar chain structure for the modification is not limited. For example, sialic acid may be added to the sugar chain of an Fc region (MAbs 2010 September-October, 2(5): 519-527). Generally, antibodies expressed in eukaryotic cells comprise glycosylation in the constant region. For example, it is known that some type of sugar chain are normally added to antibodies expressed in cells such as naturally-occurring antibody-producing cells of mammals or eukaryotic cells transformed with an expression vector comprising a DNA encoding an antibody.

Eukaryotic cells shown here include yeast and animal cells. For example, CHO cells and HEK293 cells are representative animal cells used in transformation with an expression vector comprising an antibody-encoding DNA. On the other hand, constant regions without glycosylation are also included in the present invention. Antibodies whose constant region is not glycosylated can be obtained by expressing an antibody-encoding gene in prokaryotic cells such as *Escherichia coli*.

Furthermore, a polypeptide comprising a variant Fc region of the present invention may be chemically modified with various molecules such as polyethylene glycol (PEG) and cytotoxic substances. Methods for such chemical modification of a polypeptide are established in the art.

In one aspect, the invention provides an isolated polypeptide comprising a variant Fc region with enhanced FcγRIIb-binding activity. In some aspects, the polypeptide is an antibody. In some aspects, the polypeptide is an Fc fusion protein. In one aspect, the invention provides an isolated polypeptide comprising a variant Fc region with enhanced FcγRIIb-binding activity. In some aspects, the polypeptide is an antibody. In certain embodiments, an antibody is a chimeric antibody, or a humanized antibody. The origin of an antibody is not particularly limited, but examples include a human antibody, a mouse antibody, a rat antibody, and a rabbit antibody. In some aspects, the polypeptide is an Fc fusion protein.

In particular aspects, an anti-myostatin antibody comprises a variant Fc region provided herein. In some embodiments, the antibody binds latent myostatin but does not bind mature myostatin. In some embodiments, the antibody binds myostatin propeptide but does not bind mature myostatin. In further embodiments, the anti-myostatin antibody is an antibody disclosed herein. In further embodiments, the anti-myostatin antibody comprises a VH and VL pair, or a HVR-H3, HVR-H2, HVR-H, HVR-L3, HVR-L2, or HVR-L1 as described in Table 2a, 11a, or 13. In further embodiments, the anti-myostatin antibody binds to the same epitope as, or competes for binding latent myostatin with, an antibody comprising a VH and VL pair as described herein. In further embodiments, the anti-myostatin antibody binds to the same epitope as, or competes for binding latent myostatin with, an antibody comprising a VH and VL pair as described in Table 2a, 11a, or 13.

The variable regions of antibodies that comprise a variant Fc region provided herein and the protein binding motifs of Fc fusion proteins comprising a variant Fc region can recognize any antigen. Examples of antigens that can be bound by such antibodies and fusion proteins include, but are not limited to ligands (cytokines, chemokines, growth factors, and such), receptors, cancer antigens, MHC antigens, differentiation antigens, immunoglobulins, and immune complexes partly containing immunoglobulins.

Examples of cytokines that can be bound by an antibody or fusion protein containing a variant Fc region of the invention, and/or recombinantly fused with a polypeptide comprising a disclosed variant Fc region include but are not limited to, interleukins 1 to 18, colony stimulating factors (G-CSF, M-CSF, GM-CSF, etc.), interferons (IFN-α, IFN-β, IFN-γ, etc.), growth factors (EGF, FGF, IGF, NGF, PDGF, TGF, HGF, etc.), tumor necrosis factors (TNF-α and TNF-β), lymphotoxin, erythropoietin, leptin, SCF, TPO, MCAF, and BMP.

Examples of chemokines that can be bound by an antibody or fusion protein containing a variant Fc region of the invention, and/or recombinantly fused with a polypeptide comprising a disclosed variant Fc region include but are not limited to, CC chemokines such as CCL1 to CCL28, CXC chemokines such as CXCL1 to CXCL17, C chemokines such as XCL1 to XCL2, and CX3C chemokines such as CX3CL1.

Examples of receptors that can be bound by an antibody or fusion protein containing a variant Fc region of the invention, and/or recombinantly fused with a polypeptide comprising a disclosed variant Fc region include but are not limited to, receptors belonging to receptor families such as the hematopoietic growth factor receptor family, cytokine receptor family, tyrosine kinase-type receptor family, serine/threonine kinase-type receptor family, TNF receptor family, G protein-coupled receptor family, GPI anchor-type receptor family, tyrosine phosphatase-type receptor family, adhesion factor family, and hormone receptor family. The receptors belonging to these receptor families and their characteristics have been described in many documents such as Cooke, ed. New Comprehesive Biochemistry Vol. 18B "Hormones and their Actions Part II" pp. 1-46 (1988) Elsevier Science Publishers BV; Patthy (*Cell* 61(1):13-14 (1990)); Ullrich (*Cell* 61(2):203-212 (1990)); Massagué (*Cell* 69(6):1067-1070 (1992)); Miyajima et al. (*Annu. Rev. Immunol* 10:295-331 (1992)); Taga et al. (*FASEB J.* 6:3387-3396 (1992)); Fantl et al. (*Annu. Rev. Biochem.* 62:453-481 (1993)); Smith et al. (*Cell* 76(6):959-962 (1994)); and Flower (*Biochim. Biophys. Acta* 1422(3): 207-234 (1999)).

Examples of specific receptors belonging to the above-mentioned receptor families include human or mouse erythropoietin (EPO) receptors (Jones et al., *Blood* 76(1):31-35 (1990); D'Andrea et al., *Cell* 57(2):277-285 (1989)), human or mouse granulocyte-colony stimulating factor (G-CSF) receptors (Fukunaga et al., *Proc. Natl. Acad. Sci. USA* 87(22):8702-8706 (1990), mG-CSFR; Fukunaga et al., *Cell* 61(2): 341-350 (1990)), human or mouse thrombopoietin (TPO) receptors (Vigon et al., *Proc. Natl. Acad. Sci. USA.* 89(12):5640-5644 (1992); Skoda et al., *EMBO J.* 12(7): 2645-2653 (1993)), human or mouse insulin receptors (Ullrich et al., *Nature* 313(6005):756-761 (1985)), human or mouse Flt-3 ligand receptors (Small et al., *Proc. Natl. Acad. Sci. USA.* 91(2):459-463 (1994)), human or mouse platelet-derived growth factor (PDGF) receptors (Gronwald et al., *Proc. Natl. Acad. Sci. USA.* 85(10):3435-3439 (1988)), human or mouse interferon (IFN)-α and β receptors (Uze et al., *Cell* 60(2): 225-234 (1990); Novick et al., *Cell* 77(3): 391-400 (1994)), human or mouse leptin receptors, human or mouse growth hormone (GH) receptors, human or mouse interleukin (IL)-10 receptors, human or mouse insulin-like growth factor (IGF)-I receptors, human or mouse leukemia inhibitory factor (LIF) receptors, and human or mouse ciliary neurotrophic factor (CNTF) receptors.

Cancer antigens are antigens that are expressed as cells become malignant, and they are also called tumor-specific antigens. Abnormal sugar chains that appear on cell surfaces or protein molecules when cells become cancerous are also cancer antigens, and they are also called sugar-chain cancer antigens. Examples of cancer antigens that can be bound by an antibody or fusion protein containing a variant Fc region of the invention include but are not limited to, GPC3 which is a receptor belonging to the GPI anchor-type receptor family mentioned above, and is also expressed in several cancers including liver cancer (Midorikawa et al., *Int. J. Cancer* 103(4):455-465 (2003)), as well as EpCAM which is expressed in several cancers including lung cancer (Linnenbach et al., *Proc. Natl. Acad. Sci. USA* 86(1):27-31 (1989)), CA19-9, CA15-3, and sialyl SSEA-1 (SLX).

MHC antigens are roughly classified into MHC class I antigens and MHC class II antigens. MHC class I antigens include HLA-A, -B, -C, -E, -F, -G, and -H, and MHC class II antigens include HLA-DR, -DQ, and -DP.

Examples of differentiation antigens that can be bound by an antibody or fusion protein containing a variant Fc region of the invention, and/or recombinantly fused with a polypeptide comprising a disclosed variant Fc region include but are not limited to, CD1, CD2, CD4, CD5, CD6, CD7, CD8, CD10, CD11a, CD11b, CD11c, CD13, CD14, CD15s, CD16, CD18, CD19, CD20, CD21, CD23, CD25, CD28, CD29, CD30, CD32, CD33, CD34, CD35, CD38, CD40, CD41a, CD41b, CD42a, CD42b, CD43, CD44, CD45, CD45RO, CD48, CD49a, CD49b, CD49c, CD49d, CD49e, CD49f, CD51, CD54, CD55, CD56, CD57, CD58, CD61, CD62E, CD62L, CD62P, CD64, CD69, CD71, CD73, CD95, CD102, CD106, CD122, CD126, and CDw130.

Immunoglobulins include IgA, IgM, IgD, IgG, and IgE. Immune complexes include a component of at least any of the immunoglobulins.

Other examples of antigens that can be bound by an antibody or fusion protein containing a variant Fc region of the invention, and/or recombinantly fused with a polypeptide comprising a disclosed variant Fc region include but are not limited to, 17-IA, 4-1BB, 4Dc, 6-keto-PGF1a, 8-iso-PGF2a, 8-oxo-dG, A1 adenosine receptor, A33, ACE, ACE-2, activin, activin A, activin AB, activin B, activin C, activin RIA, activin RIA ALK-2, activin RIB ALK-4, activin RIIA, activin RIIB, ADAM, ADAM10, ADAM12, ADAM15, ADAM17/TACE, ADAM8, ADAM9, ADAMTS, ADAMTS4, ADAMTS5, addressin, aFGF, ALCAM, ALK, ALK-1, ALK-7, alpha-1-antitrypsin, alpha-V/beta-1 antagonist, ANG, Ang, APAF-1, APE, APJ, APP, APRIL, AR, ARC, ART, artemin, anti-Id, ASPARTIC, atrial natriuretic peptide, av/b3 integrin, Ax1, b2M, B7-1, B7-2, B7-H, B-lymphocyte stimulating factor (BlyS), BACE, BACE-1, Bad, BAFF, BAFF-R, Bag-1, BAK, Bax, BCA-1, BCAM, Bcl, BCMA, BDNF, b-ECGF, bFGF, BID, Bik, BIM, BLC, BL-CAM, BLK, BMP, BMP-2 BMP-2a, BMP-3 Osteogenin, BMP-4, BMP-2b, BMP-5, BMP-6 Vgr-1, BMP-7 (OP-1), BMP-8 (BMP-8a, OP-2), BMPR, BMPR-IA (ALK-3), BMPR-IB (ALK-6), BRK-2, RPK-I, BMPR-II (BRK-3), BMP, b-NGF, BOK, bombesin, bone-derived neurotrophic factor, BPDE, BPDE-DNA, BTC, complement factor 3 (C3), C3a, C4, C5, C5a, C10, CA125, CAD-8, calcitonin, cAMP, carcinoembryonic antigen (CEA), cancer associated antigen, cathepsin A, cathepsin B, cathepsin C/DPPI, cathepsin D, cathepsin E, cathepsin H, cathepsin L, cathepsin O, cathepsin S, cathepsin V, cathepsin X/Z/P, CBL, CCI, CCK2, CCL, CCL1, CCL11, CCL12, CCL13, CCL14, CCL15, CCL16, CCL17, CCL18, CCL19, CCL2, CCL20, CCL21, CCL22, CCL23, CCL24, CCL25, CCL26, CCL27, CCL28, CCL3, CCL4, CCL5, CCL6, CCL7, CCL8, CCL9/10, CCR, CCR1, CCR10, CCR11, CCR2, CCR3, CCR4, CCR5, CCR6, CCR7, CCR8, CCR9, CD1, CD2, CD3, CD3E, CD4, CD5, CD6, CD7, CD8, CD10, CD11a, CD11b, CD11c, CD13, CD14, CD15, CD16, CD18, CD19, CD20, CD21, CD22, CD23, CD25, CD27L, CD28, CD29, CD30, CD30L, CD32, CD33 (p67 protein), CD34, CD38, CD40, CD40L, CD44, CD45, CD46, CD49a, CD52, CD54, CD55, CD56, CD61, CD64, CD66e, CD74, CD80 (B7-1), CD89, CD95, CD123, CD137, CD138, CD140a, CD146, CD147, CD148, CD152, CD164, CEACAM5, CFTR, cGMP, CINC, Botulinum toxin, Clostridium perfringens toxin, CKb8-1, CLC, CMV, CMV UL, CNTF, CNTN-1, COX, C-Ret, CRG-2, CT-1, CTACK, CTGF, CTLA-4, CX3CL1, CX3CR1, CXCL, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCR, CXCR1, CXCR2, CXCR3, CXCR4, CXCR5, CXCR6, cytokeratin tumor associated antigen, DAN, DCC, DcR3, DC-S1GN, complement regulatory factor (Decay accelerating factor), des(1-3)-IGF-I (brain IGF-1), Dhh, digoxin, DNAM-1, Dnase, Dpp, DPPIV/CD26, Dtk, ECAD, EDA, EDA-A1, EDA-A2, EDAR, EGF, EGFR (ErbB-1), EMA, EMMPRIN, ENA, endothelin receptor, enkephalinase, eNOS, Eot, eotaxin 1, EpCAM, ephrin B2/EphB4, EPO, ERCC, E-selectin, ET-1, factor IIa, factor VII, factor VIIIc, factor IX, fibroblast activation protein (FAP), Fas, FcR1, FEN-1, ferritin, FGF, FGF-19, FGF-2, FGF3, FGF-8, FGFR, FGFR-3, fibrin, FL, FLIP, Flt-3, Flt-4, follicle stimulating hormone, fractalkine, FZD1, FZD2, FZD3, FZD4, FZD5, FZD6, FZD7, FZD8, FZD9, FZD10, G250, Gas6, GCP-2, GCSF, GD2, GD3, GDF, GDF-1, GDF-3 (Vgr-2), GDF-5 (BMP-14, CDMP-1), GDF-6 (BMP-13, CDMP-2), GDF-7 (BMP-12, CDMP-3), GDF8 (myostatin), GDF-9, GDF-15 (MIC-1), GDNF, GFAP, GFRa-1, GFR-alpha1, GFR-alpha2, GFR-alpha3, GITR, glucagon, Glut4, glycoprotein IIb/IIIa (GPIIb/IIIa), GM-CSF, gp130, gp72, GRO, growth hormone releasing hormone, hapten (NP-cap or NIP-cap), HB-EGF, HCC, HCMV gB envelope glycoprotein, HCMV gH envelope glycoprotein, HCMV UL, hematopoietic growth factor (HGF), Hep B gp120, heparanase, Her2, Her2/neu (ErbB-2), Her3 (ErbB-3), Her4 (ErbB-4), herpes simplex virus (HSV) gB glycoprotein, HSV gD glycoprotein, HGFA, high molecular weight melanoma-associated antigen (HMW-MAA), HIV gp120, HIV IIIB gp 120 V3 loop, HLA, HLA-DR, HM1.24, HMFG PEM, HRG, Hrk, human cardiac myosin, human cytomegalovirus (HCMV), human growth hormone (HGH), HVEM, 1-309, IAP, ICAM, ICAM-1, ICAM-3, ICE, ICOS, IFNg, Ig, IgA receptor, IgE, IGF, IGF binding protein, IGF-1R, IGFBP, IGF-I, IGF-II, IL, IL-1, IL-1R, IL-2, IL-2R, IL-4, IL-4R, IL-5, IL-5R, IL-6, IL-6R, IL-8, IL-9, IL-10, IL-12, IL-13, IL-5, IL-18, IL-18R, IL-23, interferon (IFN)-alpha, IFN-beta, IFN-gamma, inhibin, iNOS, insulin A chain, insulin B chain, insulin-like growth factor1, integrin alpha2, integrin alpha3, integrin alpha4, integrin alpha4/beta1, integrin alpha4/beta7, integrin alpha5 (alpha V), integrin alpha5/beta1, integrin alpha5/beta3, integrin alpha6, integrin beta1, integrin beta2, interferon gamma, IP-10, I-TAC, JE, kallikrein 2, kallikrein 5, kallikrein 6, kallikrein 11, kallikrein 12, kallikrein 14, kallikrein 15, kallikrein L1, kallikrein L2, kallikrein L3, kallikrein L4, KC, KDR, keratinocyte growth factor (KGF), laminin 5, LAMP, LAP, LAP (TGF-1), latent TGF-1, latent TGF-1 bpi, LBP, LDGF, LECT2, lefty, Lewis-Y antigen, Lewis-Y associated antigen, LFA-1, LFA-3, Lfo, LIF, LIGHT, lipoprotein, LIX, LKN, Lptn, L-selectin, LT-a, LT-b, LTB4, LTBP-1, lung surface, luteinizing hormone, lymphotoxin beta receptor, Mac-1, MAdCAM, MAG, MAP2, MARC, MCAM, MCK-2, MCP, M-CSF, MDC, Mer, METALLOPROTEASES, MGDF receptor, MGMT, MHC (HLA-DR), MIF, MIG, MIP, MIP-1-alpha, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, MPIF, Mpo, MSK, MSP, mucin (Muc1), MUC18, Mullerian-inhibiting substance, Mug, MuSK, NAIP, NAP, NCAD, N-Cadherin, NCA 90, NCAM, neprilysin, neurotrophin-3, -4, or -6, neurturin, nerve growth factor (NGF), NGFR, NGF-beta, nNOS, NO, NOS, Npn, NRG-3, NT, NTN, OB, OGG1, OPG, OPN, OSM, OX40L, OX40R, p150, p95, PADPr, parathyroid hormone, PARC, PARP, PBR, PBSF, PCAD, P-cadherin, PCNA, PDGF, PDK-1, PECAM, PEM, PF4, PGE, PGF, PGI2, PGJ2, PIN, PLA2, placental alkaline phosphatase (PLAP), PIGF, PLP, PP 14, proinsulin, prorelaxin, protein C, PS, PSA, PSCA, prostate-specific membrane antigen (PSMA), PTEN, PTHrp, Ptk, PTN, R51, RANK, RANKL, RANTES, relaxin A chain, relaxin B chain, renin, respiratory syncytial virus (RSV) F, RSV Fgp, Ret, Rheumatoid factor, RLIP76, RPA2, RSK, S100, SCF/KL, SDF-1, SERINE, serum albumin, sFRP-3, Shh, SIGIRR, SK-1, SLAM, SLPI, SMAC, SMDF, SMOH, SOD, SPARC, Stat, STEAP, STEAP-II, TACE, TACI, TAG-72 (tumor-associated glycoprotein-72), TARC, TCA-3, T-cell receptor (for example, T-cell receptor alpha/beta), TdT, TECK, TEM1, TEM5, TEM7, TEM8, TERT, testis PLAP-like alkaline phosphatase, TfR, TGF, TGF-alpha, TGF-beta, TGF-beta Pan Specific, TGF-betaRI (ALK-5), TGF-betaRII, TGF-betaRIIb, TGF-betaRIII, TGF-beta1, TGF-beta2, TGF-beta3, TGF-beta4, TGF-beta5, thrombin, thymus Ck-1, thyroid-stimulating hormone, Tie, TIMP, TIQ, tissue factor, TMEFF2, Tmpo, TMPRSS2, TNF, TNF-alpha, TNF-alpha-beta, TNF-beta2, TNFc, TNF-RI, TNF-RII, TNFRSF10A (TRAIL R1 Apo-2, DR4), TNFRSF10B (TRAIL R2 DR5, KILLER, TRICK-2A, TRICK-B), TNFRSF10C (TRAIL R3 DcR1, LIT, TRID), TNFRSF10D (TRAIL R4 DcR2, TRUNDD), TNFRSF11A (RANK ODF R, TRANCE R), TNFRSF11B (OPG OCIF, TR1), TNFRSF12 (TWEAK R FN14), TNFRSF13B (TACI), TNFRSF13C (BAFF R), TNFRSF14 (HVEM ATAR, HveA, LIGHT R, TR2), TNFRSF16 (NGFR p75NTR), TNFRSF17 (BCMA), TNFRSF18 (GITR AITR), TNFRSF19 (TROY TAJ, TRADE), TNFRSF19L (RELT), TNFRSF1A (TNF RI CD120a, p55-60), TNFRSF1B (TNF RII CD120b, p75-80), TNFRSF26 (TNFRH3), TNFRSF3 (LTbR TNF RIII, TNFC R), TNFRSF4 (OX40 ACT35, TXGP1 R), TNFRSF5 (CD40 p50), TNFRSF6 (Fas Apo-1, APT1, CD95), TNFRSF6B (DcR3 M68, TR6), TNFRSF7 (CD27), TNFRSF8 (CD30), TNFRSF9 (4-1BB CD137, ILA), TNFRSF21 (DR6), TNFRSF22 (DcTRAIL R2 TNFRH2), TNFRST23 (DcTRAIL R1 TNFRH1), TNFRSF25 (DR3 Apo-3, LARD, TR-3, TRAMP, WSL-1), TNFSF10 (TRAIL Apo-2 ligand, TL2), TNFSF11 (TRANCE/RANK ligand ODF, OPG ligand), TNFSF12 (TWEAK Apo-3 ligand, DR3 ligand), TNFSF13 (APRIL TALL2), TNFSF13B (BAFF BLYS, TALLI, THANK, TNFSF20), TNFSF14 (LIGHT HVEM ligand, LTg), TNFSF15 (TL1A/VEGI), TNFSF18 (GITR ligand AITR ligand, TL6), TNFSF1A (TNF-a Conectin, DIF, TNFSF2), TNFSF1B (TNF-b LTa, TNFSF1), TNFSF3 (LTb TNFC, p33), TNFSF4 (OX40 ligand gp34, TXGP1), TNFSF5 (CD40 ligand CD154, gp39, HIGM1, IMD3, TRAP), TNFSF6 (Fas ligand Apo-ligand, APT1 ligand), TNFSF7 (CD27 ligand CD70), TNFSF8 (CD30 ligand CD153), TNFSF9 (4-1BB ligand CD137 ligand), TP-1, t-PA, Tpo, TRAIL, TRAIL R, TRAIL-R1, TRAIL-R2, TRANCE, transferrin receptor, TRF, Trk, TROP-2, TSG, TSLP, tumor associated antigen CA125, tumor associated antigen expressing Lewis-Y associated carbohydrates, TWEAK, TXB2, Ung, uPAR, uPAR-1, urokinase, VCAM, VCAM-1, VECAD, VE-Cadherin, VE-cadherin-2, VEFGR-1 (flt-1), VEGF, VEGFR, VEGFR-3 (flt-4), VEGI, VIM, virus antigen, VLA, VLA-1, VLA-4, VNR integrin, von Willebrand factor, WIF-1, WNT1, WNT2, WNT2B/13, WNT3, WNT3A, WNT4, WNT5A, WNT5B, WNT6, WNT7A, WNT7B, WNT8A, WNT8B, WNT9A, WNT9B, WNT10A, WNT10B, WNT11, WNT16, XCL1, XCL2, XCR1, XCR1, XEDAR, XIAP, XPD, HMGB1, IgA, Aβ, CD81, CD97, CD98, DDR1, DKK1, EREG, Hsp90, IL-17/IL-17R, IL-20/IL-20R, oxidized LDL, PCSK9, prekallikrein, RON, TMEM16F, SOD 1, Chromogranin A, Chromogranin B, tau, VAP1, high molecular weight kininogen, IL-31, IL-31R, Nav1.1, Nay 1.2, Nav1.3, Nav1.4, Nav1.5, Nav1.6, Nav1.7, Nav1.8, Nav1.9, EPCR, C1, C1q, C1r, C1s, C2, C2a, C2b, C3, C3a, C3b, C4, C4a, C4b, C5, C5a, C5b, C6, C7, C8, C9, factor B, factor D, factor H, properdin, sclerostin, fibrinogen, fibrin, prothrombin, thrombin, tissue factor, factor V, factor Va, factor VII, factor VIa, factor VIII, factor VIIIa, factor IX, factor IXa, factor X, factor Xa, factor XI, factor XIa, factor XII, factor XIIa, factor XIII, factor XIIIa, TFPI, antithrombin III, EPCR, thrombomodulin, TAPI, tPA, plasminogen, plasmin, PAI-1, PAI-2, GPC3, Syndecan-1, Syndecan-2, Syndecan-3, Syndecan-4, LPA, and SIP; and receptors for hormone and growth factors.

As discussed herein, one or more amino acid residue alterations are allowed in the amino acid sequences constituting the variable regions as long as their antigen-binding activities are maintained. When altering a variable region amino acid sequence, there is no particularly limitation on the site of alteration and number of amino acids altered. For example, amino acids present in CDR and/or FR can be altered appropriately. When altering amino acids in a variable region, the binding activity is preferably maintained without particular limitation; and for example, as compared to before alteration, the binding activity may be 50% or more, 80% or more, and 100% or more. Furthermore, the binding activity may be increased by amino acid alterations. For example, the binding activity may be 2-, 5-, 10-times higher or such than that before alteration. Alteration of amino acid sequence may be at least one of amino acid residue substitution, addition, deletion, and modification.

For example, the modification of the N-terminal glutamine of a variable region into pyroglutamic acid by pyroglutamylation is a modification well known to those skilled in the art. Thus, when the heavy-chain N terminus is glutamine, antibodies described herein may comprise the variable regions in which the glutamine is modified to pyroglutamic acid.

Antibody variable regions described herein may have any sequences, and they may be antibody variable regions of any origin, such as mouse antibodies, rat antibodies, rabbit antibodies, goat antibodies, camel antibodies, humanized antibodies produced by humanizing these non-human antibodies, and human antibodies. Furthermore, these antibodies may have various amino acid substitutions introduced into their variable regions to improve their antigen binding, pharmacokinetics, stability, and immunogenicity. Variable regions may be able to bind antigens repeatedly due to their pH dependency in antigen binding (WO 2009/125825).

κ chain and λ chain are present in antibody light-chain constant regions, and either one is acceptable. Furthermore, they may have some amino acid alterations such as substitutions, deletions, additions, and/or insertions.

Furthermore, polypeptides comprising variant Fc regions described herein may be made into Fc fusion proteins by linking to other proteins such as physiologically active peptides. Such fusion proteins may be a multimer of at least two polypeptides comprising the variant Fc regions. Examples of the other proteins include receptors, adhesion molecules, ligands, and enzymes, but are not limited thereto.

Examples of Fc fusion proteins include proteins fused with an Fc region to a receptor that binds to a target molecule, including TNFR-Fc fusion protein, IL1R-Fc fusion protein, VEGFR-Fc fusion protein, and CTLA4-Fc fusion protein (Economides et al., *Nat. Med.* 9(1):47-52 (2003); Dumont et al., *BioDrugs.* 20(3):151-60 (2006)). Furthermore, proteins to be fused may be other molecules that have a target-binding activity, for example, scFvs (WO 2005/037989), single-domain antibodies (WO 2004/058821; WO 2003/002609), antibody-like molecules (Davinder, *Curr. Op. Biotech.* 17:653-658 (2006); *Current Opinion in Biotechnology* 18:1-10 (2007); Nygren et al., *Curr. Op. Struct. Biol.* 7:463-469 (1997); and Hoss. *Protein Science* 15:14-27 (2006)) such as DARPins (WO 2002/020565), Affibody (WO 1995/001937), Avimer (WO 2004/044011; WO 2005/040229), and Adnectin (WO 2002/032925). Furthermore, antibodies and Fc fusion proteins may be multispecific and may bind to multiple types of target molecules or epitopes.

B. Recombinant Methods and Compositions

Antibodies may be produced using recombinant methods and compositions, e.g., as described in U.S. Pat. No. 4,816, 567. In one embodiment, isolated nucleic acid encoding an anti-myostatin antibody described herein is provided. In another embodiment, isolated nucleic acid encoding a polypeptide comprising a variant Fc region or a parent Fc region described herein is provided. Such nucleic acid may encode an amino acid sequence comprising the VL and/or an amino acid sequence comprising the VH of the antibody (e.g., the light and/or heavy chains of the antibody). In a further embodiment, one or more vectors (e.g., expression vectors) comprising such nucleic acid are provided. In a further embodiment, a host cell comprising such nucleic acid is provided. In one embodiment, a host cell comprises (e.g., has been transformed with): (1) a vector comprising a nucleic acid that encodes an amino acid sequence comprising the VL of the antibody and an amino acid sequence comprising the VH of the antibody, or (2) a first vector comprising a nucleic acid that encodes an amino acid sequence comprising the VL of the antibody and a second vector comprising a nucleic acid that encodes an amino acid sequence comprising the VH of the antibody. In one embodiment, the host cell is eukaryotic, e.g., a Chinese Hamster Ovary (CHO) cell or lymphoid cell (e.g., a Y0, NS0, and Sp20 cell). In one embodiment, a method of making an anti-myostatin antibody is provided, wherein the method comprises culturing a host cell comprising a nucleic acid encoding the antibody, as provided above, under conditions suitable for expression of the antibody, and optionally recovering the antibody from the host cell (or host cell culture medium). In another embodiment, a method of making a polypeptide comprising a variant Fc region or a parent Fc region is provided, wherein the method comprises culturing a host cell comprising the nucleic acid(s) encoding a polypeptide such as, an antibody, Fc region, or variant Fc region, as provided herein, under conditions suitable for expression of the polypeptide, and optionally recovering the polypeptide from the host cell (or host cell culture medium).

For recombinant production of an anti-myostatin antibody, nucleic acids encoding an antibody, e.g., as described above, is isolated and inserted into one or more vectors for further cloning and/or expression in a host cell. For recombinant production of an Fc region, nucleic acid encoding an Fc region is isolated and inserted into one or more vectors for further cloning and/or expression in a host cell. Such nucleic acid may be readily isolated and sequenced using conventional procedures (e.g., using oligonucleotide probes that are capable of binding specifically to genes encoding the heavy and light chains of the antibody).

Suitable host cells for cloning or expression of antibody-encoding vectors include prokaryotic or eukaryotic cells described herein. For example, antibodies may be produced in bacteria, in particular when glycosylation and Fc effector function are not needed. For expression of antibody fragments and polypeptides in bacteria, see, e.g., U.S. Pat. Nos. 5,648,237, 5,789,199, and 5,840,523. (See also, Charlton, *Methods in Molecular Biology*, Vol. 248 (B. K. C. Lo, ed., Humana Press, Totowa, N.J., 2003), pp. 245-254, describing expression of antibody fragments in *E. coli*.) After expression, the antibody may be isolated from the bacterial cell paste in a soluble fraction and can be further purified.

In addition to prokaryotes, eukaryotic microbes such as filamentous fungi or yeast are suitable cloning or expression hosts for antibody-encoding vectors, including fungi and yeast strains whose glycosylation pathways have been "humanized," resulting in the production of an antibody with a partially or fully human glycosylation pattern. See Gerngross, *Nat. Biotech.* 22:1409-1414 (2004), and Li et al., *Nat. Biotech.* 24:210-215 (2006).

Suitable host cells for the expression of glycosylated antibody are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells.

Plant cell cultures can also be utilized as hosts. See, e.g., U.S. Pat. Nos. 5,959,177, 6,040,498, 6,420,548, 7,125,978, and 6,417,429 (describing PLANTIBODIES™ technology for producing antibodies in transgenic plants).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., *J. Gen Virol.* 36:59 (1977)); baby hamster kidney cells (BHK); mouse sertoli cells (TM4 cells as described, e.g., in Mather, Biol. Reprod. 23:243-251 (1980)); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells, as described, e.g., in Mather et al., *Annals N. Y. Acad. Sci.* 383:44-68 (1982); MRC 5 cells; and FS4 cells. Other useful mammalian host cell lines include Chinese hamster ovary (CHO) cells, including DHFR⁻ CHO cells (Urlaub et al., *Proc. Natl. Acad. Sci. USA* 77:4216 (1980)); and myeloma cell lines such as Y0, NS0 and Sp2/0. For a review of certain mammalian host cell lines suitable for antibody production, see, e.g., Yazaki and Wu, *Methods in Molecular Biology*, Vol. 248 (B. K. C. Lo, ed., Humana Press, Totowa, N.J.), pp. 255-268 (2003).

Antibodies with pH-dependent characteristics may be obtained using screening methods and/or mutagenesis methods e.g., as described in WO 2009/125825. The screening methods may comprise any process by which an antibody having pH-dependent binding characteristics is identified within a population of antibodies specific for a particular antigen. In certain embodiments, the screening methods may comprise measuring one or more binding parameters (e.g., KD or kd) of individual antibodies within an initial population of antibodies both at acidic and neutral pH. The binding parameters of the antibodies may be measured using, e.g., surface plasmon resonance, or any other analytic method that allows for the quantitative or qualitative assessment of the binding characteristics of an antibody to a particular antigen. In certain embodiments, the screening methods may comprise identifying an antibody that binds to an antigen with an acidic/neutral KD ratio of 2 or greater. In further embodiments, the screening methods may comprise identifying an antibody that binds to an antigen with a pH5.8/pH7.4 KD ratio of 2 or greater. Alternatively, the screening methods may comprise identifying an antibody that binds to an antigen with an acidic/neutral kd ratio of 2 or greater. In further embodiments, the screening methods may comprise identifying an antibody that binds to an antigen with a pH5.8/pH7.4 kd ratio of 2 or greater.

In another embodiment, the mutagenesis methods may comprise incorporating a deletion, substitution, or addition of an amino acid within the heavy and/or light chain of the antibody to enhance the pH-dependent binding of the antibody to an antigen. In certain embodiments, the mutagenesis may be carried out within one or more variable domains of the antibody, e.g., within one or more HVRs (e.g., CDRs). For example, the mutagenesis may comprise substituting an amino acid within one or more HVRs (e.g., CDRs) of the antibody with another amino acid. In certain embodiments, the mutagenesis may comprise substituting one or more amino acids in at least one HVR (e.g., CDR) of the antibody with a histidine. In certain embodiments, "enhanced pH-dependent binding" means that the mutated version of the antibody exhibits a greater acidic/neutral KD ratio, or a greater acidic/neutral kd ratio, than the original "parent" (i.e., the less pH-dependent) version of the antibody prior to mutagenesis. In certain embodiments, the mutated version of the antibody has an acidic/neutral KD ratio of 2 or greater. In certain embodiments, the mutated version of the antibody has a pH5.8/pH7.4 KD ratio of 2 or greater. Alternatively, the mutated version of the antibody has an acidic/neutral kd ratio of 2 or greater. In further embodiments, the mutated version of the antibody has a pH5.8/pH7.4 kd ratio of 2 or greater.

Polyclonal antibodies are preferably raised in animals by multiple subcutaneous (sc) or intraperitoneal (ip) injections of the relevant antigen and an adjuvant. It may be useful to conjugate the relevant antigen to a protein that is immunogenic in the species to be immunized, e.g., keyhole limpet hemocyanin, serum albumin, bovine thyroglobulin, or soybean trypsin inhibitor using a bifunctional or derivatizing agent, for example, maleimidobenzoyl sulfosuccinimide ester (conjugation through cysteine residues), N-hydroxysuccinimide (through lysine residues), glutaraldehyde, succinic anhydride, $SOCl_2$, or $R^1N\!\!=\!\!C\!\!=\!\!NR$, where R and $R^1$ are different alkyl groups.

Animals (usually non-human mammals) are immunized against the antigen, immunogenic conjugates, or derivatives by combining, e.g., 100 μg or 5 μg of the protein or conjugate (for rabbits or mice, respectively) with 3 volumes of Freund's complete adjuvant and injecting the solution intradermally at multiple sites. One month later the animals are boosted with ⅕ to ⅒ the original amount of peptide or conjugate in Freund's complete adjuvant by subcutaneous injection at multiple sites. Seven to 14 days later the animals are bled and the serum is assayed for antibody titer. Animals are boosted until the titer plateaus. Preferably, the animal is boosted with the conjugate of the same antigen, but conjugated to a different protein and/or through a different cross-linking reagent. Conjugates also can be made in recombinant cell culture as protein fusions. Also, aggregating agents such as alum are suitably used to enhance the immune response.

Monoclonal antibodies are obtained from a population of substantially homogeneous antibodies, i.e., the individual antibodies comprising the population are identical except for possible naturally occurring mutations and/or post-translational modifications (e.g., isomerizations, amidations) that may be present in minor amounts. Thus, the modifier "monoclonal" indicates the character of the antibody as not being a mixture of discrete antibodies.

For example, the monoclonal antibodies may be made using the hybridoma method first described by Kohler et al., *Nature* 256(5517):495-497 (1975). In the hybridoma method, a mouse or other appropriate host animal, such as a hamster, is immunized as hereinabove described to elicit lymphocytes that produce or are capable of producing antibodies that will specifically bind to the protein used for immunization. Alternatively, lymphocytes may be immunized in vitro.

The immunizing agent will typically include the antigenic protein or a fusion variant thereof. Generally either peripheral blood lymphocytes (PBLs) are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell (Goding, Monoclonal Antibodies: Principles and Practice, Academic Press (1986), pp. 59-103).

Immortalized cell lines are usually transformed mammalian cells, particularly myeloma cells of rodent, bovine and human origin. Usually, rat or mouse myeloma cell lines are employed. The hybridoma cells thus prepared are seeded and grown in a suitable culture medium that preferably contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which are substances that prevent the growth of HGPRT-deficient cells.

Preferred immortalized myeloma cells are those that fuse efficiently, support stable high-level production of antibody by the selected antibody-producing cells, and are sensitive to a medium such as HAT medium. Among these, preferred are murine myeloma lines, such as those derived from MOPC-21 and MPC-11 mouse tumors available from the Salk Institute Cell Distribution Center, San Diego, Calif. USA, and SP-2 cells (and derivatives thereof, e.g., X63-Ag8-653) available from the American Type Culture Collection, Manassas, Va. USA. Human myeloma and mouse-human heteromyeloma cell lines also have been described for the production of human monoclonal antibodies (Kozbor et al. *J. Immunol.* 133(6):3001-3005 (1984); Brodeur et al., *Monoclonal Antibody Production Techniques and Applications*, Marcel Dekker, Inc., New York, pp. 51-63 (1987)).

Culture medium in which hybridoma cells are growing is assayed for production of monoclonal antibodies directed against the antigen. Preferably, the binding specificity of monoclonal antibodies produced by hybridoma cells is determined by immunoprecipitation or by an in vitro binding assay, such as radioimmunoassay (RIA) or enzyme-linked immunosorbent assay (ELISA). Such techniques and assays are known in the art. For example, binding affinity may be determined by the Scatchard analysis of Munson, *Anal. Biochem.* 107(1):220-239 (1980).

After hybridoma cells are identified that produce antibodies of the desired specificity, affinity, and/or activity, the clones may be subcloned by limiting dilution procedures and grown by standard methods (Goding, supra). Suitable culture media for this purpose include, for example, D-MEM or RPMI-1640 medium. In addition, the hybridoma cells may be grown in vivo as tumors in a mammal.

The monoclonal antibodies secreted by the subclones are suitably separated from the culture medium, ascites fluid, or serum by conventional immunoglobulin purification procedures such as, for example, protein A-Sepharose, hydroxyapatite chromatography, gel electrophoresis, dialysis, or affinity chromatography.

Antibodies may be produced by immunizing an appropriate host animal against an antigen. In one embodiment, the antigen is a polypeptide comprising a full-length myostatin. In one embodiment, the antigen is a polypeptide comprising latent myostatin. In one embodiment, the antigen is a polypeptide comprising a myostatin propeptide. In one embodiment, the antigen is a polypeptide comprising the region corresponding to the amino acids at positions 21 to 100 of myostatin propeptide (SEQ ID NO: 78). In one embodiment, the antigen is a polypeptide comprising amino acids at positions 21-80, 41-100, 21-60, 41-80, 61-100, 21-40, 41-60, 61-80, or 81-100 of myostatin propeptide (SEQ ID NO: 78). Also included in the present invention are antibodies produced by immunizing an animal against the antigen. The antibodies may incorporate any of the features, singly or in combination, as described in "Exemplary Anti-myostatin Antibodies" above.

An Fc region may be obtained by re-eluting the fraction adsorbed onto protein A column after partially digesting IgG1, IgG2, IgG3, IgG4 monoclonal antibodies or such using a protease such as pepsin. The protease is not particularly limited as long as it can digest a full-length antibody so that Fab and F(ab')2 will be produced in a restrictive manner by appropriately setting the enzyme reaction conditions such as pH, and examples include pepsin and papain.

Furthermore, the present invention provides a method for producing a polypeptide comprising a variant Fc region with enhanced FcγRIIb-binding activity in comparison with a polypeptide comprising a parent Fc region, which comprises introducing at least one amino acid alteration to the parent Fc region. In some aspects, the produced polypeptide is an antibody. In certain embodiments, an antibody is a chimeric antibody, or a humanized antibody. In some aspects, the produced polypeptide is an Fc fusion protein.

In certain embodiments, the production method comprises the following steps: (a) preparing a polypeptide comprising a parent Fc region; (b) introducing at least one amino acid alteration to the parent Fc region within the polypeptide; (c) measuring the monkey FcγRIIb-binding activities of the polypeptide comprising the parent Fc region and the polypeptide comprising the Fc region in step (b); and (d) selecting a polypeptide comprising a variant Fc region with enhanced monkey FcγRIIb-binding activity in comparison with the polypeptide comprising the parent Fc region.

In certain embodiments, the production method comprises the following steps: (a) preparing a polypeptide comprising a parent Fc region; (b) introducing at least one amino acid alteration to the parent Fc region within the polypeptide; (c) measuring the monkey FcγRIIIa-binding activities of the polypeptide comprising the parent Fc region and the polypeptide comprising the Fc region in step (b); and (d) selecting a polypeptide comprising a variant Fc region with decreased monkey FcγRIIIa-binding activity in comparison with the polypeptide comprising the parent Fc region.

In certain embodiments, the production method comprises the following steps: (a) preparing a polypeptide comprising a parent Fc region; (b) introducing at least one amino acid alteration to the parent Fc region within the polypeptide; (c) measuring the human FcγRIIb-binding activities of the polypeptide comprising the parent Fc region and the polypeptide comprising the Fc region in step (b); and (d) selecting a polypeptide comprising a variant Fc region with enhanced human FcγRIIb-binding activity in comparison with the polypeptide comprising the parent Fc region.

In certain embodiments, the production method comprises the following steps: (a) preparing a polypeptide comprising a parent Fc region; (b) introducing at least one amino acid alteration to the parent Fc region within the polypeptide; (c) measuring the human FcγRIIIa-binding activities of the polypeptide comprising the parent Fc region and the polypeptide comprising the Fc region in step (b); and (d) selecting a polypeptide comprising a variant Fc region with decreased human FcγRIIIa-binding activity in comparison with the polypeptide comprising the parent Fc region.

In certain embodiments, the production method comprises the following steps: (a) preparing a polypeptide comprising a parent Fc region; (b) introducing at least one amino acid alteration to the parent Fc region within the polypeptide; (c) measuring the human FcγRIIa (type H)-binding activities of the polypeptide comprising the parent Fc region and the polypeptide comprising the Fc region in step (b); and (d) selecting a polypeptide comprising a variant Fc region with decreased human FcγRIIa (type H)-binding activity in comparison with the polypeptide comprising the parent Fc region.

In certain embodiments, the production method comprises the following steps: (a) preparing a polypeptide comprising a parent Fc region; (b) introducing at least one amino acid alteration to the parent Fc region within the polypeptide; (c) measuring the human FcγRIIa (type R)-binding activities of the polypeptide comprising the parent Fc region and the polypeptide comprising the Fc region in step (b); and (d) selecting a polypeptide comprising a variant Fc region with decreased human FcγRIIa (type R)-binding activity in comparison with the polypeptide comprising the parent Fc region.

In one aspect, at least one amino acid is altered in the above-mentioned method for producing a polypeptide comprising a variant Fc region with enhanced FcγRIIb-binding activity, of at least one position selected from the group consisting of: 231, 232, 233, 234, 235, 236, 237, 238, 239, 264, 266, 267, 268, 271, 295, 298, 325, 326, 327, 328, 330, 331, 332, 334, and 396, according to EU numbering. In certain embodiments, the FcγRIIb has the sequence of cynomolgous monkey FcγRIIb (SEQ ID NO:223), In certain embodiments, the FcγRIIb has the sequence of human FcγRIIb (e.g., SEQ ID NOs:212, 213, or 214).

In another aspect, one amino acid is altered in the above-mentioned method for producing a polypeptide comprising a variant Fc region with enhanced FcγRIIb-binding activity, at position 236.

In another aspect, at least two amino acids are altered in the above-mentioned method for producing a polypeptide comprising a variant Fc region with enhanced FcγRIIb-binding activity, the alterations comprising: (a) one amino acid alteration at position 236, and (b) at least one amino acid alteration of at least one position selected from the group consisting of: 231, 232, 233, 234, 235, 237, 238, 239, 264, 266, 267, 268, 271, 295, 298, 325, 326, 327, 328, 330, 331, 332, 334, and 396, according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In another aspect, at least two amino acids are altered in the above-mentioned method for producing a polypeptide comprising a variant Fc region with enhanced FcγRIb-binding activity, the alterations comprising: (a) one amino acid alteration at position 236, and (b) at least one amino acid alteration of at least one position selected from the group consisting of: 231, 232, 235, 239, 268, 295, 298, 326, 330, and 396, according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In another aspect, at least two amino acids are altered in the above-mentioned method for producing a polypeptide comprising a variant Fc region with enhanced FcγRIIb-binding activity, the alterations comprising: (a) one amino acid alteration at position 236, and (b) at least one amino acid alteration of at least one position selected from the group consisting of: 268, 295, 326, and 330, according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In another aspect, amino acids are altered in the above-mentioned method for producing a polypeptide comprising a variant Fc region with enhanced FcγRIIb-binding activity, at positions of any one of the following (1)-(37): (1) at positions 231, 236, 239, 268 and 330; (2) at positions 231, 236, 239, 268, 295 and 330; (3) at positions 231, 236, 268 and 330; (4) at positions 231, 236, 268, 295 and 330; (5) at positions 232, 236, 239, 268, 295 and 330; (6) at positions 232, 236, 268, 295 and 330; (7) at positions 232, 236, 268 and 330; (8) at positions 235, 236, 268, 295, 326 and 330; (9) at positions 235, 236, 268, 295 and 330; (10) at positions 235, 236, 268 and 330; (11) at positions 235, 236, 268, 330 and 396; (12) at positions 235, 236, 268 and 396; (13) at positions 236, 239, 268, 295, 298 and 330; (14) at positions 236, 239, 268, 295, 326 and 330; (15) at positions 236, 239, 268, 295 and 330; (16) at positions 236, 239, 268, 298 and 330; (17) at positions 236, 239, 268, 326 and 330; (18) at positions 236, 239, 268 and 330; (19) at positions 236, 239, 268, 330 and 396; (20) at positions 236, 239, 268 and 396; (21) at positions 236 and 268; (22) at positions 236, 268 and 295; (23) at positions 236, 268, 295, 298 and 330; (24) at positions 236, 268, 295, 326 and 330; (25) at positions 236, 268, 295, 326, 330 and 396; (26) at positions 236, 268, 295 and 330; (27) at positions 236, 268, 295, 330 and 396; (28) at positions 236, 268, 298 and 330; (29) at positions 236, 268, 298 and 396; (30) at positions 236, 268, 326 and 330; (31) at positions 236, 268, 326, 330 and 396; (32) at positions 236, 268 and 330; (33) at positions 236, 268, 330 and 396; (34) at positions 236, 268 and 396; (35) at positions 236 and 295; (36) at positions 236, 330 and 396; and (37) at positions 236 and 396; according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In a further aspect, an amino acid alteration in the above-mentioned method for producing a polypeptide comprising a variant Fc region with enhanced FcγRIIb-binding activity, is selected at each position from the group consisting of: (a) Asp, Glu, Phe, Gly, His, Ile, Lys, Leu, Met, Asn, Pro, Gln, Arg, Ser, Thr, Val, Trp, Tyr at position 231; (b) Ala, Asp, Glu, Phe, Gly, His, Ile, Lys, Leu, Met, Asn, Gln, Arg, Ser, Thr, Val, Trp, Tyr at position 232; (c) Asp at position 233; (d) Trp, Tyr at position 234; (e) Trp at position 235; (f) Ala, Asp, Glu, His, Ile, Leu, Met, Asn, Gln, Ser, Thr, Val at position 236; (g) Asp, Tyr at position 237; (h) Glu, Ile, Met, Gln, Tyr at position 238; (i) Ile, Leu, Asn, Pro, Val at position 239; (j) Ile at position 264; (k) Phe at position 266; (l) Ala, His, Leu at position 267; (m) Asp, Glu at position 268; (n) Asp, Glu, Gly at position 271; (o) Leu at position 295; (p) Leu at position 298; (q) Glu, Phe, Ile, Leu at position 325; (r) Thr at position 326; (s) Ile, Asn at position 327; (t) Thr at position 328; (u) Lys, Arg at position 330; (v) Glu at position 331; (w) Asp at position 332; (x) Asp, Ile, Met, Val, Tyr at position 334; and (y) Ala, Asp, Glu, Phe, Gly, His, Ile, Lys, Leu, Met, Asn, Gln, Arg, Ser, Thr, Val, Trp, Tyr at position 396; according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In a further aspect, an amino acid alteration in the above-mentioned method for producing a polypeptide comprising a variant Fc region with enhanced FcγRIIb-binding activity, is selected at each position from the group consisting of: (a) Gly, Thr at position 231; (b) Asp at position 232; (c) Trp at position 235; (d) Asn, Thr at position 236; (e) Val at position 239; (f) Asp, Glu at position 268; (g) Leu at position 295; (h) Leu at position 298; (i) Thr at position 326; (j) Lys, Arg at position 330, and (k) Lys, Met at position 396; according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In a further aspect, amino acid alterations in the above-mentioned method for producing a polypeptide comprising a variant Fc region with enhanced FcγRIIb-binding activity, are: Asn at position 236, Glu at position 268, Lys at position 330, and Met at position 396; according to EU numbering. In a further aspect, amino acid alterations in the above-mentioned method for producing a polypeptide comprising a variant Fc region with enhanced FcγRIIb-binding activity, are: Asn at position 236, Asp at position 268, and Lys at position 330; according to EU numbering. In a further aspect, amino acid alterations in the above-mentioned method for producing a polypeptide comprising a variant Fc region with enhanced FcγRIIb-binding activity, are: Asn at position 236, Asp at position 268, Leu at position 295, and Lys at position 330; according to EU numbering. In a further aspect, amino acid alterations in the above-mentioned method for producing a polypeptide comprising a variant Fc region with enhanced FcγRIIb-binding activity, are: Thr at position 236, Asp at position 268, and Lys at position 330; according to EU numbering. In a further aspect, amino acid alterations in the above-mentioned method for producing a polypeptide comprising a variant Fc region with enhanced FcγRIIb-binding activity, are: Asn at position 236, Asp at position 268, Leu at position 295, Thr at position 326, and Lys at position 330; according to EU numbering. In a further aspect, amino acid alterations in the above-mentioned method for producing a polypeptide comprising a variant Fc region with enhanced FcγRIIb-binding activity, are: Trp at position 235, Asn at position 236, Asp at position 268, Leu at position 295, Thr at position 326, and Lys at position 330; according to EU numbering.

In one aspect, at least one amino acid is altered in the above-mentioned method for producing a polypeptide comprising a variant Fc region with enhanced FcγRIIb-binding activity, of at least one position selected from the group consisting of: 234, 238, 250, 264, 267, 307, and 330 according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In another aspect, one amino acid is altered in the above-mentioned method for producing a polypeptide comprising a variant Fc region with enhanced FcγRIIb-binding activity, at position 238.

In another aspect, at least two amino acids are altered in the above-mentioned method for producing a polypeptide comprising a variant Fc region with enhanced FcγRIIb-binding activity, the alterations comprising: (i) one amino acid alteration at position 238, and (ii) at least one amino acid alteration of at least one position selected from the group consisting of: 234, 250, 264, 267, 307, and 330 according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

In another aspect, amino acids are altered in the above-mentioned method for producing a polypeptide comprising a variant Fc region with enhanced FcγRIIb-binding activity, at positions of any one of the following (1)-(9): (1) at positions 234, 238, 250, 307 and 330; (2) at positions 234, 238, 250, 264, 307 and 330; (3) at positions 234, 238, 250, 264, 267, 307 and 330; (4) at positions 234, 238, 250, 267, 307 and 330; (5) at positions 238, 250, 264, 307 and 330; (6) at positions 238, 250, 264, 267, 307 and 330; (7) at positions 238, 250, 267, 307 and 330; (8) at positions 238, 250 and 307; and (9) at positions 238, 250, 307 and 330; according to EU numbering.

In a further aspect, an amino acid alteration in the above-mentioned method for producing a polypeptide comprising a variant Fc region with enhanced FcγRIIb-binding activity, is selected at each position from the group consisting of: (a) Tyr at position 234; (b) Asp at position 238; (c) Val at position 250; (d) Ile at position 264; (e) Ala at position 267; (f) Pro at position 307; and (g) Lys at position 330; according to EU numbering. In a further aspect, amino acid alterations in the above-mentioned method for producing a polypeptide comprising a variant Fc region with enhanced FcγRIIb-binding activity, are: Asp at position 238; according to EU numbering. In a further aspect, amino acid alterations in the above-mentioned method for producing a polypeptide comprising a variant Fc region with enhanced FcγRIb-binding activity, are: Asp at position 238, Val at position 250, and Pro at position 307; according to EU numbering. In a further aspect, amino acid alterations in the above-mentioned method for producing a polypeptide comprising a variant Fc region with enhanced FcγRIIb-binding activity, are: Asp at position 238, Val at position 250, Pro at position 307, and Lys at position 330; according to EU numbering. In a further aspect, amino acid alterations in the above-mentioned method for producing a polypeptide comprising a variant Fc region with enhanced FcγRIIb-binding activity, are: Asp at position 238, Val at position 250, Ile at position 264, Pro at position 307, and Lys at position 330; according to EU numbering. In a further aspect, amino acid alterations in the above-mentioned method for producing a polypeptide comprising a variant Fc region with enhanced FcγRIIb-binding activity, are: Asp at position 238, Val at position 250, Ala at position 267, Pro at position 307, and Lys at position 330; according to EU numbering. In a further aspect, amino acid alterations in the above-mentioned method for producing a polypeptide comprising a variant Fc region with enhanced FcγRIIb-binding activity, are: Tyr at position 234, Asp at position 238, Val at position 250, Pro at position 307, and Lys at position 330; according to EU numbering. In a further aspect, amino acid alterations in the above-mentioned method for producing a polypeptide comprising a variant Fc region with enhanced FcγRIIb-binding activity, are: Tyr at position 234, Asp at position 238, Val at position 250, Ala at position 267, Pro at position 307, and Lys at position 330; according to EU numbering. In a further aspect, amino acid alterations in the above-mentioned method for producing a polypeptide comprising a variant Fc region with enhanced FcγRIIb-binding activity, are: Asp at position 238, Val at position 250, Ile at position 264, Ala at position 267, Pro at position 307, and Lys at position 330; according to EU numbering. In a further aspect, amino acid alterations in the above-mentioned method for producing a polypeptide comprising a variant Fc region with enhanced FcγRIIb-binding activity, are: Tyr at position 234, Asp at position 238, Val at position 250, Ile at position 264, Pro at position 307, and Lys at position 330; according to EU numbering. In a further aspect, amino acid alterations in the above-mentioned method for producing a polypeptide comprising a variant Fc region with enhanced FcγRIIb-binding activity, are: Tyr at position 234, Asp at position 238, Val at position 250, Ile at position 264, Ala at position 267, Pro at position 307, and Lys at position 330; according to EU numbering. In certain embodiments, the FcγRIIb has the sequence of cynomolgous monkey FcγRIIb (SEQ ID NO:223). In certain embodiments, the FcγRIIb has the sequence of human FcγRIIb (e.g., SEQ ID NOs:212, 213, or 214).

Furthermore, the present invention provides a method for producing a polypeptide comprising a variant Fc region with increased pI in comparison with a polypeptide comprising a parent Fc region, which comprises introducing at least two amino acid alterations to the parent Fc region.

In certain embodiments, the production method for producing a polypeptide comprising a variant Fc region provided herein comprises the following steps: (a) preparing a polypeptide comprising a parent Fc region; (b) introducing at least two amino acid alterations to the parent Fc region within the polypeptide; (c) measuring the pI's of the polypeptide comprising the parent Fc region and the polypeptide comprising the Fc region in step (b); and (d) selecting a polypeptide comprising a variant Fc region with increased pI in comparison with the corresponding polypeptide comprising the parent Fc region.

In one aspect, at least two amino acids are altered in the above-mentioned method for producing a polypeptide comprising a variant Fc region with increased pI, of at least two positions selected from the group consisting of: 285, 311, 312, 315, 318, 333, 335, 337, 341, 342, 343, 384, 385, 388, 390, 399, 400, 401, 402, 413, 420, 422, and 431, according to EU numbering. In a further aspect, the produced polypeptide comprises a variant Fc region with increased pI, of at least two positions selected from the group consisting of: 311, 341, 343, 384, 399, 400, 401, 402, and 413, according to EU numbering.

In another aspect, amino acids are altered in the above-mentioned method for producing a polypeptide comprising a variant Fc region with increased pI, at positions of any one of the following (1)-(10): (1) at positions 311 and 341; (2) at positions 311 and 343; (3) at positions 311, 343 and 413; (4) at positions 311, 384 and 413; (5) at positions 311 and 399; (6) at positions 311 and 401; (7) at positions 311 and 413; (8) at positions 400 and 413; (9) at positions 401 and 413; and (10) at positions 402 and 413; according to EU numbering. In a further aspect, amino acid alterations in the above-mentioned method for producing a polypeptide comprising a variant Fc region with increased pI, are: Arg at position 400 and Lys at position 413; according to EU numbering. In a further aspect, amino acid alterations in the above-mentioned method for producing a polypeptide comprising a variant Fc region with increased pI, are: Arg at position 311 and Lys at position 413; according to EU numbering. In a further aspect, amino acid alterations in the above-mentioned method for producing a polypeptide comprising a variant Fc region with increased pI, are: Arg at position 311 and Arg at position 399; according to EU numbering. In a further aspect, amino acid alterations in the above-mentioned method for producing a polypeptide comprising a variant Fc region with increased pI, are: Arg at position 311 and Arg at position 343; according to EU numbering. In a further aspect, amino acid alterations in the above-mentioned method for producing a polypeptide comprising a variant Fc region with increased pI, are: Arg at position 311 and Arg at position 413; according to EU numbering. In a further aspect, amino acid alterations in the above-mentioned method for producing a polypeptide comprising a variant Fc region with increased pI, are: Arg at position 311, Arg at position 343, and Arg at position 413; according to EU numbering. In a further aspect, amino acid alterations in the above-mentioned method for producing a polypeptide comprising a variant Fc region with increased pI, are: Arg at position 311, Arg at position 384, and Arg at position 413; according to EU numbering.

In a further aspect, the amino acid alterations in the above-mentioned method for producing a polypeptide comprising a variant Fc region with increased pI, are selected from Lys or Arg at each position.

In a further aspect, the amino acid alterations in the above-mentioned production methods are selected from any single alteration, combination of single alterations, or combination alterations described in Tables 14-30.

Optionally, the following additional steps can be included in the above-mentioned methods for producing a polypeptide comprising a variant Fc region, when the polypeptide further comprises an antigen-binding domain: (e) assessing pharmacokinetic of the antigen in plasma, after administration of the polypeptide comprising the parent Fc region and the polypeptide comprising the variant Fc region in animals such as mice, rats, rabbits, dogs, monkeys, and humans; and (f) selecting a polypeptide comprising a variant Fc region with enhanced ability of antigen elimination from plasma in comparison with the polypeptide comprising the parent Fc region.

Polypeptides comprising a variant Fc region produced by any of the above-mentioned methods or other methods know in the art are included in the present invention.

C. Assays

Anti-myostatin antibodies provided herein may be identified, screened for, or characterized for their physical/chemical properties and/or biological activities by various assays known in the art.

Variant Fc regions provided herein may be identified, screened for, or characterized for their physical/chemical properties and/or biological activities by various assays described herein or otherwise known in the art.

1. Binding Assays and Other Assays

In one aspect, an antibody of the invention is tested for its antigen binding activity, by known methods such as ELISA, Western blot, BIACORE®, etc. In one aspect, a polypeptide comprising an variant Fc region of the invention is tested for its Fc receptor binding activity, by known methods such as BIACORE®, etc.

In another aspect, competition assays may be used to identify an antibody that competes for binding to myostatin with any anti-myostatin antibody described herein. In certain embodiments, when such a competing antibody is present in excess, it blocks (e.g., reduces) the binding of a reference antibody to myostatin by at least 10%, 15%, 20%, 25%, 30%, 35%, 40%, 45%, 50%, 55%, 60%, 65%, 70%, 75% or more. In some instances, binding is inhibited by at least 80%, 85%, 90%, 95%, or more. In certain embodiments, such a competing antibody binds to the same epitope (e.g., a linear or a conformational epitope) that is bound by an anti-myostatin antibody described herein (e.g., an anti-myostatin antibody described in Tables 2a, 11a, or 13). In further aspects, the reference antibody has a VH and a VL pair described in Table 2a, 11a, or 13. Detailed exemplary methods for mapping an epitope to which an antibody binds are provided in Morris (1996) "Epitope Mapping Protocols," in *Methods in Molecular Biology* vol. 66 (Humana Press, Totowa, N.J.).

In an exemplary competition assay, immobilized latent myostatin or myostatin propeptide is incubated in a solution comprising a first labeled antibody that binds to the myostatin and a second unlabeled antibody that is being tested for its ability to compete with the first antibody for binding to the myostatin. The second antibody may be present in a hybridoma supernatant. As a control, immobilized myostatin is incubated in a solution comprising the first labeled antibody but not the second unlabeled antibody. After incubation under conditions permissive for binding of the first antibody to the myostatin, excess unbound antibody is removed, and the amount of label associated with immobilized myostatin is measured. If the amount of label associated with immobilized myostatin is substantially reduced in the test sample relative to the control sample, then that indicates that the second antibody is competing with the first antibody for binding to the myostatin. See, Harlow and Lane (1988) *Antibodies: A Laboratory Manual* ch. 14 (Cold Spring Harbor Laboratory, Cold Spring Harbor, N.Y.).

In another exemplary competition assay, BIACORE® analysis is used to determine the ability of a test anti-myostatin antibody to compete with the binding to myostatin by a second (reference) anti-myostatin antibody. In a further aspect in which a BIACORE® instrument (for example, the BIACORE® 3000) is operated according to the manufacturer's recommendations, myostatin protein (e.g., latent myostatin or myostatin propeptide) is captured on a CM5 BIACORE® chip using a standard technique known in the art to generate a myostatin-coated surface. Typically 200-800 resonance units of myostatin would be coupled to the chip (an amount that gives easily measurable levels of binding but that is readily saturable by the concentrations of test antibody being used). The two antibodies (i.e., the test and reference antibody) to be assessed for their ability to compete with each other are mixed at a 1:1 molar ratio of binding sites in a suitable buffer to create a test mixture. When calculating the concentrations on a binding site basis the molecular weight of a test or reference antibody is assumed to be the total molecular weight of the corresponding antibody divided by the number of myostatin-binding sites on the antibody. The concentration of each antibody (i.e., test and reference antibody) in the test mixture should be high enough to readily saturate the binding sites for that antibody on the myostatin molecules captured on the BIACORE® chip. The test and reference antibodies in the mixture are at the same molar concentration (on a binding basis), typically between 1.00 and 1.5 micromolar (on a binding site basis). Separate solutions containing the test antibody alone and the reference antibody alone are also prepared. Test antibody and reference antibody in these solutions should be in the same buffer and at the same concentration and conditions as in the test mixture. The test mixture containing the test antibody and reference antibody is passed over the myostatin-coated BIACORE® chip and the total amount of binding is recorded. The chip is then treated in such a way as to remove the bound test or reference antibody without damaging the chip-bound myostatin. Typically, this is done by treating the chip with 30 mM HCl for 60 seconds. The solution of test antibody alone is then passed over the myostatin-coated surface and the amount of binding recorded. The chip is again treated to remove all of the bound antibody without damaging the chip-bound myostatin. The solution of reference antibody alone is then passed over the myostatin-coated surface and the amount of binding recorded. The maximum theoretical binding of the mixture of test antibody and reference antibody is next calculated, and is the sum of the binding of each antibody (i.e. test and reference) when passed over the myostatin surface alone. If the actual recorded binding of the mixture is less than this theoretical maximum then test antibody and reference antibody are competing with each other for binding myostatin. Thus, in general, a competing test anti-myostatin antibody is one which will bind to myostatin in the above BIACORE® blocking assay such that during the assay and in the presence of the reference anti-myostatin antibody the recorded binding is between 80% and 0.1% (e.g., 80%>to 4%) of the maximum theoretical binding, specifically between 75% and 0.1% (e.g., 75% to 4%) of the maximum theoretical binding, and more specifically between 70% and 0.1% (e.g., 70% to 4%) of maximum theoretical binding (as defined above) of the test antibody and reference antibody in combination.

Assays for determining the binding activity of a polypeptide containing a variant Fc region towards one or more FcγR family members are described herein or otherwise known in the art. Such binding assays include but are not limited to BIACORE® analysis, which utilizes the surface plasmon resonance (SPR) phenomena, Amplified Luminescent Proximity Homogeneous Assay (ALPHA) screening, ELISA, and fluorescence activated cell sorting (FACS) (Lazar et al., *Proc. Natl. Acad. Sci. USA* (2006) 103(11): 4005-4010).

In one embodiment, BIACORE® analysis can be used to evaluate whether the binding activity of a polypeptide comprising a variant Fc region is enhanced, or maintained or decreased with respect to a particular FcγR family member. For example, by observing whether there is a decrease or an increase in the dissociation constant (KD) value obtained from sensorgram analysis, where various FcγRs are subjected to interaction as an analyte with polypeptides comprising a variant Fc region immobilized or captured onto the sensor chip using known methods and reagents such as Protein A, Protein L, Protein A/G, Protein G, anti-lamda chain antibodies, anti-kappa chain antibodies, antigenic peptides, antigenic proteins). Alterations in binding activity can also be determined by comparing changes in the resonance unit (RU) value on the sensorgram before and after the one or more types of FcγRs are subjected to interaction as analytes with the captured polypeptides comprising the variant Fc region. Alternatively, FcγR can be immobilized or captured onto the sensor chips, and the polypeptides comprising the variant Fc region are used as an analyte.

In BIACORE® analysis, one of the substances (the ligand) in observation of an interaction is immobilized onto a gold thin film on a sensor chip, and by shining light from the reverse side of the sensor chip so that total reflection takes place at the interface between the gold thin film and glass, a portion of reduced reflection intensity is formed in part of the reflected light (SPR signal). When the other one of the substances (the analyte) in observation of an interaction is made to flow on the sensor chip surface and the ligand binds to the analyte, the mass of the immobilized ligand molecule increases and the refractive index of the solvent on the sensor chip surface changes. The position of the SPR signal shifts as a result of this change in refractive index (on the other hand, the signal position returns when this binding dissociates). The BIACORE® system indicates the amount of shift mentioned above, or more specifically the time variable of mass by plotting the change in mass on the sensor chip surface on the ordinate as the measurement data (sensorgram). The amount of analyte bound to the ligand trapped on the sensor chip surface is determined from the sensorgram. Kinetic parameters such as association rate constants (ka) and dissociation rate constants (kd) are determined from the curves of the sensorgram, and the dissociation constants (KD) are determined from the ratio of these constants. In the BIACORE® method, a method for measuring inhibition is preferably used. An example of the method for measuring inhibition is described in Lazar et al., *Proc. Natl. Acad. Sci. USA* 103(11):4005-4010 (2006).

ALPHA screening is performed by ALPHA technology which uses two beads, a donor and an acceptor, based on the following principles. Luminescent signals are detected only when molecules bound to donor beads physically interact with molecules bound to the acceptor beads, and the two beads are in close proximity to each other. Laser-excited photosensitizer in the donor beads converts ambient oxygen to excited-state singlet oxygen. Singlet oxygen is dispersed around the donor beads, and when it reaches the adjacent acceptor beads, chemiluminescent reaction is induced in the beads, and light is ultimately emitted. When the molecules bound to the donor beads do not interact with the molecules bound to the acceptor beads, the chemiluminescent reaction does not take place because singlet oxygen produced by the donor beads does not reach the acceptor beads.

For example, a biotinylated polypeptide complex is bound to the donor beads, and Fcγ receptor tagged with glutathione S transferase (GST) is linked to the acceptor beads. In the absence of a competing polypeptide complex comprising a variant Fc region, the polypeptide complex comprising a parent Fc region interacts with the Fcγ receptor and produces 520-620 nm signals. The polypeptide complex comprising an untagged variant Fc region competes with the polypeptide complex comprising a parent Fc region for interaction with the Fcγ receptor. Relative binding activities can be determined by quantifying the decrease in fluorescence observed as a result of the competition. Biotinylation of polypeptide complexes such as antibodies using Sulfo-NHS-biotin and such is well known. The method of expressing the Fcγ receptor and GST in a cell carrying a fusion gene produced by fusing a polynucleotide encoding the Fcγ receptor in frame with a polynucleotide encoding GST in an expressible vector, and performing purification using a glutathione column is appropriately adopted as a method for tagging an Fcγ receptor with GST. The obtained signals are preferably analyzed, for example, by fitting them to a one-site competition model which uses a non-linear regression analysis using software such as GRAPHPAD PRISM (GraphPad, San Diego).

A variant Fc region with decreased FcγR-binding activity refers to an Fc region which binds to FcγR with essentially weaker binding activity than a parent Fc region when assays are performed using substantially the same amount of a corresponding parent Fc region and a variant Fc region. Furthermore, a variant Fc region with enhanced FcγR-binding activity refers to an Fc region which binds to FcγR with essentially stronger binding activity than a corresponding parent Fc region when assays are performed using substantially the same amount of a parent Fc region and a variant Fc region. A variant Fc region with maintained FcγR-binding activity refers to an Fc region that binds to FcγR with binding activity equivalent to or essentially not different from that of a parent Fc region when assays are performed using substantially the same amount of the corresponding parent Fc region and the polypeptide containing the variant Fc region.

Whether or not the binding activities of an Fc region towards various FcγRs were enhanced or decreased can be determined from the increase or decrease in the amount of binding of the various FcγRs to the Fc region, which were determined according to the above-mentioned measurement method. Here, the amount of binding of the various FcγRs to the Fc region can be evaluated as a value obtained by dividing the difference in the RU values of sensorgrams that changed before and after interaction of various FcγRs as the analyte with the Fc region, by the difference in the RU values of sensorgrams that changed before and after capturing the Fc regions to the sensor chips.

In the present invention, enhanced FcγRIIb-binding activity preferably means, for example, that the ratio of [KD value of a parent Fc region for FcγRIIb]/[KD value of a variant Fc region for FcγRIIb] in the KD values measured by the above-mentioned measurement method preferably becomes 2.0 or greater, 3.0 or greater, 4.0 or greater, 5.0 or greater, 6.0 or greater, 7.0 or greater, 8.0 or greater, 9.0 or greater, 10 or greater, 15 or greater, 20 or greater, 25 or greater, 30 or greater, 35 or greater, 40 or greater, 45 or greater, or even 50 or greater, 55 or greater, 60 or greater, 65 or greater, 70 or greater, 75 or greater, 80 or greater, 85 or greater, 90 or greater, 95 or greater, or 100 or greater.

The KD value (mol/L) of a variant Fc region described herein for FcγRIIb is preferably less than that of a parent Fc region for FcγRIIb, and may be, for example, $2.0\times10^{-6}$ M or smaller, $1.0\times10^{-6}$ M or smaller, $9.0\times10^{-7}$ M or smaller, $8.0\times10^{-7}$ M or smaller, $7.0\times10^{-7}$ M or smaller, $6.0\times10^{-7}$ M or smaller, $5.0\times10^{-7}$ M or smaller, $4.0\times10^{-7}$ M or smaller, $3.0\times10^{-7}$ M or smaller, $2.0\times10^{-7}$ M or smaller, $1.0\times10^{-7}$ M or smaller, $9.0\times10^{-8}$ M or smaller, $8.0\times10^{-8}$ M or smaller, $7.0\times10^{-8}$ M or smaller, $6.0\times10^{-8}$ M or smaller, $5.0\times10^{-8}$ M or smaller.

Furthermore, a variant Fc region with enhanced binding selectivity to FcγRIIb compared to FcγRIIa refers to an Fc region where: (a) FcγRIIb-binding activity is enhanced, and FcγRIIa-binding activity is maintained or decreased; (b) FcγRIIb-binding activity is enhanced and FcγRIIa-binding activity is also enhanced, but the degree of enhancement of FcγRIIa-binding activity is lower than the degree of enhancement of FcγRIIb-binding activity; or (c) FcγRIIb-binding activity is decreased and FcγRIIa-binding activity is also decreased, but the degree of decrease of FcγRIIb-binding activity is less than the degree of decrease of FcγRIIa-binding activity. Whether or not a variant Fc region has improved binding selectivity for FcγRIIb rather than for FcγRIIa can be determined, for example, by comparing the ratio of the KD value for FcγRIIa to the KD value for FcγRIIb of the variant Fc region (the ratio of [KD value of the variant Fc region for FcγRIIa]/[KD value of the variant Fc region for FcγRIIb]), with the ratio of the KD value for FcγRIIa to the KD value for FcγRIIb of the parent Fc region (the ratio of [KD value of the parent Fc region for FcγRIIa]/[KD value of the parent Fc region for FcγRIIb]), which were determined according to the above-mentioned examples. Specifically, when the KD ratio for the variant Fc region is greater than that of the parent Fc region, the variant Fc region can be determined to have an improved binding selectivity for FcγRIIb rather than for FcγRIIa in comparison with the parent Fc region. Especially in human, the FcγRIIb-binding activity is likely to correlate with binding activity to FcγRIIa (type R) than to FcγRIIa (type H) since the amino acid sequence of FcγRIIb shares higher identity with FcγRIIa (type R) than FcγRIIa (type H). Therefore, finding amino acid alteration(s) that can enhance binding selectivity to human FcγRIIb compared to human FcγRIIa (type R) is important for enhancing binding selectivity to FcγRIIb compared to FcγRIIa in humans.

When a variant Fc region of the present invention has higher binding activity against FcγRIIb and lower binding activity against FcγRIII (such as FcγRIIIa or FcγRIIIb) compared to those of a parent Fc region, the variant Fc region can be said to be FcγRIIb-specific.

2. Activity Assays

In one aspect, assays are provided for identifying anti-myostatin antibodies having biological activity. Biological activity may include, e.g., inhibiting the activation of myostatin, blocking the release of mature myostatin from latent myostatin, inhibiting the proteolytic cleavage of latent myostatin, blocking the access of a protease to latent myostatin, etc. Antibodies having such biological activity in vivo and/or in vitro are also provided. In certain embodiments, an antibody of the invention is tested for such biological activity.

In certain embodiments, whether a test antibody inhibits the cleavage of latent myostatin is determined by detecting the cleavage product of latent myostatin (myostatin) using a method known in the art such as electrophoresis, chromatography, immunoblot analysis, an enzyme-linked immunosorbent assay (ELISA), or mass spectrometry, after a protease that can cleave latent myostatin is contacted with the latent myostatin in the presence or absence of the test antibody (see, for example, Thies et al., *Growth Factors* 18(4):251-259 (2001)). Where a decreased amount of the cleavage product of latent myostatin (e.g., human myostatin propeptide) is detected in the presence of (or following contact with) the test antibody, the test antibody is identified as an antibody that can inhibit the cleavage of latent myostatin. In certain embodiments, whether a test antibody blocks access of a protease to latent myostatin is determined by methods for the detection of protein interactions between the protease and latent myostatin, e.g., ELISAs or BIA-CORE®. Where a decreased interaction between the protease and latent myostatin is detected in the presence of (or following contact with) the test antibody, the test antibody is identified as an antibody that can block access of the protease to latent myostatin.

In certain embodiments, whether a test antibody blocks the release of mature myostatin from latent myostatin is determined by detecting mature myostatin activity, for example, the activity of binding to a myostatin receptor, or the activity of mediating signal transduction in a cell expressing a myostatin receptor (e.g., ActRIIb). Cells useful for such an assay can be those that express an endogenous myostatin receptor, for example, L6 myocytes, or can be those that are genetically modified, transiently or stably, to express a transgene encoding a myostatin receptor, for example, an activin receptor such as an activin type II receptor (Thies et al, Supra). Binding of myostatin to a myostatin receptor can be detected using a receptor binding assay. Myostatin mediated signal transduction can be detected at any level in the signal transduction pathway, for example, by examining phosphorylation of a Smad polypeptide, examining expression of a myostatin regulated gene including a reporter gene, or measuring proliferation of a myostatin-dependent cell. Where a decreased mature myostatin activity is detected in the presence of (or following contact with) the test antibody, the test antibody is identified as an antibody that can block the release of mature myostatin from latent myostatin.

Inhibition of myostatin activation can also be detected and/or measured using the methods set forth and exemplified in the working examples. Using assays of these or other suitable types, test antibodies can be screened for those capable of inhibiting the activation of myostatin. In certain embodiments, inhibition of myostatin activation includes at least a 5%, 10%, 15%, 20%, 25%, 30%, 35%, or 40% or greater decrease in myostatin activation in the assay as compared to a negative control under similar conditions. In some embodiments, it refers to the inhibition of myostatin activation of at least 45%, 50%, 55%, 60%, 65%, 70%, 75%, 80%, 85%, 90%, or 95% or greater.

In another aspect, assays for identifying anti-myostatin antibodies that form an immune complex (i.e., an antigen-antibody complex) with myostatin are provided. Antibodies having such biological activity in vivo and/or in vitro are also provided.

In certain embodiments, an antibody of the invention is tested for such biological activity.

In certain embodiments, the formation of an immune complex is evaluated by a method such as size exclusion (gel filtration) chromatography, ultracentrifugation, light scattering, electron microscope, or mass spectrometry (*Mol. Immunol.* 39:77-84 (2002), *Mol. Immunol.* 47:357-364 (2009)). These methods make use of the property that an immune complex is a larger molecule than an antibody alone, or an antigen alone. Where a large complex containing two or more antibodies and two or more antigens (e.g., myostatin molecules) is detected in the presence of a test antibody and an antigen, the test antibody is identified as an antibody that can form an immune complex containing two or more antibodies and two or more molecules of myostatin. In another embodiment, formation of an immune complex is evaluated by a method such as, ELISA, FACS, or SPR (surface plasmon resonance assay; for example, using BIA-CORE®) (Shields et al., *J Biol. Chem.* 276(9):6591-6604 (2001); Singh et al., *J. Immunol. Methods* 50:109-114 (1982); Suzuki et al., *J. Immunol.* 184(4): 1968-1976 (2010); Luo et al., *mAbs* 1(5):491-504 (2009)). These methods make use of the property that an immune complex containing two or more antibodies and two or more antigens can bind more strongly to an Fc receptor or a complement component than an antibody or antigen alone can. Where an increased binding to an Fc receptor or a complement component is detected in the presence of both a test antibody and an antigen compared to in the presence of an antibody alone, the test antibody is identified as an antibody that can form an immune complex containing two or more antibodies and two or more molecules of myostatin. In another embodiment, formation of an immune complex is evaluated by administering a test antibody to an animal (e.g., a mouse) and measuring the clearance of antigen from plasma. As described above, an antibody which forms an immune complex containing two or more antibodies with two or more antigens is expected to accelerate the elimination of antigens from plasma. Therefore, where an accelerated elimination of myostatin from plasma is observed in a test antibody-administered mouse compared to in a reference antibody-administered mouse, the test antibody is identified as an antibody that can form an immune complex containing two or more antibodies and two or more molecules of myostatin more efficiently than the reference antibody.

D. Immunoconjugates

In some embodiments, the invention provides immunoconjugates comprising an anti-myostatin antibody herein conjugated to one or more cytotoxic agents, such as chemotherapeutic agents or drugs, growth inhibitory agents, toxins (e.g., protein toxins, enzymatically active toxins of bacterial, fungal, plant, or animal origin, or fragments thereof), or radioactive isotopes.

In some embodiments, the invention provides immunoconjugates comprising a polypeptide comprising a variant Fc region herein conjugated to one or more cytotoxic agents, such as chemotherapeutic agents or drugs, growth inhibitory agents, toxins (e.g., protein toxins, enzymatically active toxins of bacterial, fungal, plant, or animal origin, or fragments thereof), or radioactive isotopes.

In one embodiment, an immunoconjugate is an antibody-drug conjugate (ADC) in which an antibody is conjugated to one or more drugs, including but not limited to a maytansinoid (see U.S. Pat. Nos. 5,208,020, 5,416,064 and EP Patent EP 0 425 235 B1); an auristatin such as monomethylauristatin drug moieties DE and DF (MMAE and MMAF) (see U.S. Pat. Nos. 5,635,483 and 5,780,588, and U.S. Pat. No. 7,498,298); a dolastatin; a calicheamicin or derivative thereof (see U.S. Pat. Nos. 5,712,374, 5,714,586, 5,739,116, 5,767,285, 5,770,701, 5,770,710, 5,773,001, and 5,877,296; Hinman et al., *Cancer Res.* 53:3336-3342 (1993); and Lode et al., *Cancer Res.* 58:2925-2928 (1998)); an anthracycline such as daunomycin or doxorubicin (see Kratz et al., *Current Med. Chem.* 13:477-523 (2006); Jeffrey et al., *Bioorganic & Med. Chem. Letters* 16:358-362 (2006); Torgov et al., *Bioconj. Chem.* 16:717-721 (2005); Nagy et al., *Proc. Natl. Acad. Sci. USA* 97:829-834 (2000); Dubowchik et al., *Bioorg. & Med. Chem. Letters* 12:1529-1532 (2002); King et al., *J. Med. Chem.* 45:4336-4343 (2002); and U.S. Pat. No. 6,630,579); methotrexate; vindesine; a taxane such as docetaxel, paclitaxel, larotaxel, tesetaxel, and ortataxel; a trichothecene; and CC 1065.

In another embodiment, an immunoconjugate comprises an antibody as described herein conjugated to an enzymatically active toxin or fragment thereof, including but not limited to diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and a tricothecene.

In another embodiment, an immunoconjugate comprises an antibody as described herein conjugated to a radioactive atom to form a radioconjugate. A variety of radioactive isotopes are available for the production of radioconjugates. Examples include $At^{211}$, $I^{131}$, $I^{125}$, $Y^{90}$, $Re^{186}$, $Re^{188}$, $Sm^{153}$, $Bi^{212}$, $P^{32}$, $Pb^{212}$ and radioactive isotopes of Lu. When the radioconjugate is used for detection, it may comprise a radioactive atom for scintigraphic studies, for example tc99m or I123, or a spin label for nuclear magnetic resonance (NMR) imaging (also known as magnetic resonance imaging, mri), such as iodine-123 again, iodine-131, indium-111, fluorine-19, carbon-13, nitrogen-15, oxygen-17, gadolinium, manganese and iron.

Conjugates of an antibody and cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., *Science* 238:1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO 1994/11026. The linker may be a "cleavable linker" facilitating release of a cytotoxic drug in the cell. For example, an acid-labile linker, peptidase-sensitive linker, photolabile linker, dimethyl linker or disulfide-containing linker (Chari et al., *Cancer Res.* 52:127-131 (1992); U.S. Pat. No. 5,208,020) may be used.

The immunoconjugates or ADCs herein expressly contemplate, but are not limited to such conjugates prepared with cross-linker reagents including, but not limited to, BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, Ill., U.S.A).

E. Methods and Compositions for Diagnostics and Detection

In certain embodiments, any of the anti-myostatin antibodies provided herein is useful for detecting the presence of myostatin in a biological sample. The term "detecting" as used herein encompasses quantitative or qualitative detection. In certain embodiments, a biological sample comprises a cell or tissue, such as serum, whole blood, plasma, biopsy sample, tissue sample, cell suspension, saliva, sputum, oral fluid, cerebrospinal fluid, amniotic fluid, ascites fluid, milk, colostrum, mammary gland secretion, lymph, urine, sweat, lacrimal fluid, gastric fluid, synovial fluid, peritoneal fluid, ocular lens fluid or mucus. In particular embodiments, the biological sample comprises whole blood. In additional embodiments, the biological sample comprises serum or plasma.

In one embodiment, an anti-myostatin antibody for use in a method of diagnosis or detection is provided. In a further aspect, a method of detecting the presence of latent myostatin or myostatin propeptide in a biological sample is provided. In certain embodiments, the method comprises contacting the biological sample with an anti-myostatin antibody as described herein under conditions permissive for binding of the anti-myostatin antibody to myostatin, and detecting whether a complex is formed between the anti-myostatin antibody and myostatin. Such method may be an in vitro or in vivo method. In one embodiment, an anti-myostatin antibody is used to select subjects eligible for therapy with an anti-myostatin antibody, e.g., where myostatin (e.g, latent myostatin) is a biomarker for selection of patients.

Exemplary disorders that may be diagnosed using an antibody of the invention include but are not limited to, muscular dystrophy (MD; including Duchenne muscular dystrophy), amyotrophic lateral sclerosis (ALS), muscle atrophy, organ atrophy, carpal tunnel syndrome, frailty, congestive obstructive pulmonary disease (COPD), sarcopenia, cachexia, muscle wasting syndromes, HIV-induced muscle wasting, type 2 diabetes, impaired glucose tolerance, metabolic syndrome (including syndrome X), insulin resistance (including resistance induced by trauma, e.g., burns or nitrogen imbalance), adipose tissue disorders (e.g., obesity, dyslipidemia, nonalcoholic fatty liver disease, etc.), osteoporosis, osteopenia, osteoarthritis, and metabolic bone disorders (including low bone mass, premature gonadal failure, androgen suppression, vitamin D deficiency, secondary hyperparathyroidism, nutritional deficiencies, and anorexia nervosa).

In certain embodiments, labeled anti-myostatin antibodies are provided. Labels include, but are not limited to, labels or moieties that are detected directly (such as fluorescent, chromophoric, electron-dense, chemiluminescent, and radioactive labels), as well as moieties, such as enzymes or ligands, that are detected indirectly, e.g., through an enzymatic reaction or molecular interaction. Exemplary labels include, but are not limited to, the radioisotopes $^{32}$P, $^{14}$C, $^{125}$I, $^{3}$H, and $^{131}$I, fluorophores such as rare earth chelates or fluorescein and its derivatives, rhodamine and its derivatives, dansyl, umbelliferone, luceriferases, e.g., firefly luciferase and bacterial luciferase (U.S. Pat. No. 4,737,456), luciferin, 2,3-dihydrophthalazinediones, horseradish peroxidase (HRP), alkaline phosphatase, β-galactosidase, glucoamylase, lysozyme, saccharide oxidases, e.g., glucose oxidase, galactose oxidase, and glucose-6-phosphate dehydrogenase, heterocyclic oxidases such as uricase and xanthine oxidase, coupled with an enzyme that employs hydrogen peroxide to oxidize a dye precursor such as HRP, lactoperoxidase, or microperoxidase, biotin/avidin, spin labels, bacteriophage labels, stable free radicals, and the like.

F. Pharmaceutical Formulations

Pharmaceutical formulations of an anti-myostatin antibody as described herein are prepared by mixing such antibody having the desired degree of purity with one or more optional pharmaceutically acceptable carriers (*Remington's Pharmaceutical Sciences* 16th edition, Osol, A. Ed. (1980)), in the form of lyophilized formulations or aqueous solutions.

Pharmaceutical formulations of a polypeptide comprising a variant Fc region as described herein are prepared by mixing such polypeptide having the desired degree of purity with one or more optional pharmaceutically acceptable carriers in the form of lyophilized formulations or aqueous solutions.

Pharmaceutically acceptable carriers are generally non-toxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as polyethylene glycol (PEG). Exemplary pharmaceutically acceptable carriers herein further include insterstitial drug dispersion agents such as soluble neutral-active hyaluronidase glycoproteins (sHASEGP), for example, human soluble PH-20 hyaluronidase glycoproteins, such as rHuPH20 (HYLENEX®, Baxter International, Inc.). Certain exemplary sHASEGPs and methods of use, including rHuPH20, are described in US Publ. Nos. 2005/0260186 and 2006/0104968. In one aspect, a sHASEGP is combined with one or more additional glycosaminoglycanases such as chondroitinases.

Exemplary lyophilized antibody formulations are described in U.S. Pat. No. 6,267,958. Aqueous antibody formulations include those described in U.S. Pat. No. 6,171,586 and WO 2006/044908, the latter formulations including a histidine-acetate buffer.

The formulation herein may also contain more than one active ingredients as necessary for the particular indication being treated, preferably those with complementary activities that do not adversely affect each other. Such active ingredients are suitably present in combination in amounts that are effective for the purpose intended.

Active ingredients may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in *Remington's Pharmaceutical Sciences* 16th edition, Osol, A. Ed. (1980).

Sustained-release preparations may be prepared. Suitable examples of sustained-release preparations include semipermeable matrices of solid hydrophobic polymers containing the antibody, which matrices are in the form of shaped articles, e.g., films, or microcapsules.

The formulations to be used for in vivo administration are generally sterile. Sterility may be readily accomplished, e.g., by filtration through sterile filtration membranes.

G. Therapeutic Methods and Compositions

Any of the anti-myostatin antibodies provided herein may be used in therapeutic methods. Likewise, any of the polypeptides comprising an variant Fc region provided herein may be used in therapeutic methods.

In one aspect, an anti-myostatin antibody for use as a medicament is provided. In further aspects, an anti-myostatin antibody for use in treating a muscle wasting disease is provided. In certain embodiments, an anti-myostatin antibody for use in a method of treatment is provided. In certain embodiments, the invention provides an anti-myostatin antibody for use in a method of treating an individual having a muscle wasting disease comprising administering to the individual an effective amount of the anti-myostatin antibody. In one embodiment, the method further comprises administering to the individual an effective amount of at least one additional therapeutic agent. In further embodiments, the invention provides an anti-myostatin antibody for use in increasing mass of muscle tissue. In certain embodiments, the invention provides an anti-myostatin antibody for use in a method of increasing mass of muscle tissue in an individual comprising administering to the individual an effective amount of the anti-myostatin antibody to increase mass of muscle tissue. In further embodiments, the invention provides an anti-myostatin antibody for use in increasing strength of muscle tissue. In certain embodiments, the invention provides an anti-myostatin antibody for use in a method of increasing strength of muscle tissue in an individual comprising administering to the individual an effective amount of the anti-myostatin antibody to increase strength of muscle tissue. In further embodiments, the invention provides an anti-myostatin antibody for use in reducing body fat accumulation. In certain embodiments, the invention provides an anti-myostatin antibody for use in a method of reducing body fat accumulation in an individual comprising administering to the individual an effective amount of the anti-myostatin antibody to reduce body fat accumulation. An "individual" according to any of the above embodiments is preferably a human.

An anti-myostatin antibody of the present invention may exhibit pH-dependent binding characteristics. In further embodiments, the invention provides an anti-myostatin antibody for use in enhancing the clearance of myostatin from plasma. In certain embodiments, the invention provides an anti-myostatin antibody for use in a method of enhancing the clearance of myostatin from plasma in an individual comprising administering to the individual an effective amount of the anti-myostatin antibody to enhance the clearance of myostatin from plasma. In one embodiment, an anti-myostatin antibody with pH-dependent binding characteristics enhances the clearance of myostatin from plasma, compared to a conventional anti-myostatin antibody which does not have pH-dependent binding characteristics. In a further embodiment, an anti-myostatin antibody with a pH-dependent binding characteristic between binding at pH5.8 and pH7.4 enhances the clearance of myostatin from plasma, compared to a conventional anti-myostatin antibody which does not have pH-dependent binding characteristics. An "individual" according to any of the above embodiments is preferably a human.

In a further aspect, the invention provides the use of an anti-myostatin antibody in the manufacture or preparation of a medicament. In one embodiment, the medicament is for treatment of a muscle wasting disease. In a further embodiment, the medicament is for use in a method of treating a muscle wasting disease comprising administering to an individual having a muscle wasting disease an effective amount of the medicament. In one embodiment, the method further comprises administering to the individual an effective amount of at least one additional therapeutic agent. In a further embodiment, the medicament is for increasing mass of muscle tissue. In a further embodiment, the medicament is for use in a method of increasing mass of muscle tissue in an individual comprising administering to the individual an effective amount of the medicament to increase mass of muscle tissue. In a further embodiment, the medicament is for increasing strength of muscle tissue. In a further embodiment, the medicament is for use in a method of increasing strength of muscle tissue in an individual comprising administering to the individual an effective amount of the medicament to increase strength of muscle tissue. In a further embodiment, the medicament is for reducing body fat accumulation. In a further embodiment, the medicament is for use in a method of reducing body fat accumulation in an individual comprising administering to the individual an effective amount of the medicament to reduce body fat accumulation. An "individual" according to any of the above embodiments may be a human.

An anti-myostatin antibody of the present invention may exhibit pH-dependent binding characteristics. In a further embodiment, the medicament is for enhancing the clearance of myostatin from plasma. In a further embodiment, the medicament is for use in a method of enhancing the clearance of myostatin from plasma in an individual comprising administering to the individual an effective amount of the medicament to enhance the clearance of myostatin from plasma. In one embodiment, an anti-myostatin antibody with pH-dependent binding characteristics enhances the clearance of myostatin from plasma, compared to a conventional anti-myostatin antibody which does not have pH-dependent binding characteristics. In a further embodiment, the anti-myostatin antibody exhibits different pH-dependent binding characteristics between pH5.8 and pH7.4. An "individual" according to any of the above embodiments is preferably a human.

In another aspect, the invention provides a method for treating a muscle wasting disease. In one embodiment, the method comprises administering to an individual having such a muscle wasting disease an effective amount of an anti-myostatin antibody provided herein. In one embodiment, the method further comprises administering to the individual an effective amount of at least one additional therapeutic agent. The "individual" according to any of the above embodiments may be a human.

In another aspect, the invention provides a method for increasing mass of muscle tissue in an individual. In one embodiment, the method comprises administering to the individual an effective amount of an anti-myostatin antibody provided herein to increase mass of muscle tissue. In one embodiment, the "individual" is a human.

In another aspect, the invention provides a method for increasing strength of muscle tissue in an individual. In one embodiment, the method comprises administering to the individual an effective amount of an anti-myostatin antibody provided herein to increase strength of muscle tissue. In one embodiment, the "individual" is a human.

In another aspect, the invention provides a method for reducing body fat accumulation in an individual. In one embodiment, the method comprises administering to the individual an effective amount of an anti-myostatin antibody provided herein to reduce body fat accumulation. In one embodiment, the "individual" is a human.

An anti-myostatin antibody of the present invention may exhibit pH-dependent binding characteristics. In a further embodiment, the invention provides a method for enhancing the clearance of myostatin from plasma in an individual. In one embodiment, the method comprises administering to the individual an effective amount of an anti-myostatin antibody provided herein to enhance the clearance of myostatin from plasma. In one embodiment, an anti-myostatin antibody with pH-dependent binding characteristics enhances the clearance of myostatin from plasma, compared to a conventional anti-myostatin antibody which does not have pH-dependent binding characteristics. In a further embodiment, the anti-myostatin antibody exhibits different pH-dependent binding characteristics between pH5.8 and pH7.4. In one embodiment, an "individual" is a human.

In a further aspect, the invention provides pharmaceutical formulations comprising any of the anti-myostatin antibodies provided herein, e.g., for use in any of the above therapeutic methods. In one embodiment, a pharmaceutical formulation comprises any of the anti-myostatin antibodies provided herein and a pharmaceutically acceptable carrier. In another embodiment, a pharmaceutical formulation comprises any of the anti-myostatin antibodies provided herein and at least one additional therapeutic agent.

In a further aspect, the pharmaceutical formulation is for treatment of a muscle wasting disease. In a further embodiment, the pharmaceutical formulation is for increasing mass of muscle tissue. In a further embodiment, the pharmaceutical formulation is for increasing strength of muscle tissue. In a further embodiment, the pharmaceutical formulation is for reducing body fat accumulation. An anti-myostatin antibody of the present invention may exhibit pH-dependent binding characteristics. In a further embodiment, the pharmaceutical formulation is for enhancing the clearance of myostatin from plasma. In one embodiment, the pharmaceutical formulation is administered to an individual having a muscle wasting disease. An "individual" according to any of the above embodiments is preferably a human.

In a further aspect, the invention provides methods for preparing a medicament or a pharmaceutical formulation, comprising mixing any of the anti-myostatin antibodies provided herein with a pharmaceutically acceptable carrier, e.g., for use in any of the above therapeutic methods. In one embodiment, the methods for preparing a medicament or a pharmaceutical formulation further comprise adding at least one additional therapeutic agent to the medicament or pharmaceutical formulation.

In certain embodiments, a muscle wasting disease is selected from the group consisting of muscular dystrophy (MD; including Duchenne muscular dystrophy), amyotrophic lateral sclerosis (ALS), muscle atrophy, organ atrophy, carpal tunnel syndrome, frailty, congestive obstructive pulmonary disease (COPD), sarcopenia, cachexia, muscle wasting syndromes, HIV-induced muscle wasting, type 2 diabetes, impaired glucose tolerance, metabolic syndrome (including syndrome X), insulin resistance (including resistance induced by trauma, e.g., burns or nitrogen imbalance), adipose tissue disorders (e.g., obesity, dyslipidemia, nonalcoholic fatty liver disease, etc.), osteoporosis, osteopenia, osteoarthritis, and metabolic bone disorders (including low bone mass, premature gonadal failure, androgen suppression, vitamin D deficiency, secondary hyperparathyroidism, nutritional deficiencies, and anorexia nervosa).

Any of the polypeptide comprising a variant Fc region provided herein may be used in therapeutic methods. In a further aspect, the invention provides pharmaceutical formulations comprising a polypeptide comprising any of the polypeptides comprising variant Fc regions provided herein, e.g., for use in therapeutic methods. In one embodiment, a pharmaceutical formulation comprises a polypeptide comprising any of the polypeptides comprising variant Fc regions provided herein and a pharmaceutically acceptable carrier. In another embodiment, a pharmaceutical formulation comprises a polypeptide comprising any of the variant Fc regions provided herein and at least one additional therapeutic agent.

In one aspect, a polypeptide comprising a variant Fc region for use as a medicament is provided. In further aspects, a polypeptide comprising a variant Fc region for use in treating a disorder is provided. In certain embodiments, a polypeptide comprising a variant Fc region for use in a method of treatment is provided. In certain embodiments, the invention provides a polypeptide comprising a variant Fc region for use in a method of treating an individual having a disorder comprising administering to the individual an effective amount of the polypeptide comprising a variant Fc region provided herein. In one embodiment, the method further comprises administering to the individual an effective amount of at least one additional therapeutic agent. In one embodiment, the "individual" is a human.

In a further aspect, the invention provides the use of a polypeptide comprising a variant Fc region in the manufacture or preparation of a medicament. In one embodiment, the medicament is for treatment of a disorder. In some aspects, the polypeptide is an antibody. In some aspects, the polypeptide is an Fc fusion protein. In a further embodiment, the medicament is for use in a method of treating a disorder comprising administering to an individual having the disorder to be treated an effective amount of the medicament. In one embodiment, the method further comprises administering to the individual an effective amount of at least one additional therapeutic agent. In one embodiment, the "individual" is a human.

In a further aspect, the invention provides a method for treating a disorder. In one embodiment, the method comprises administering to an individual having such a disorder an effective amount of a polypeptide comprising a variant Fc region. In one embodiment, the method further comprises administering to the individual an effective amount of at least one additional therapeutic agent. In one embodiment, the "individual" is a human.

In a further aspect, the invention provides pharmaceutical formulations comprising a polypeptide comprising a variant Fc region provided herein, for use in a therapeutic method such as any of the therapeutic methods described herein. In one embodiment, a pharmaceutical formulation comprises a polypeptide comprising a variant Fc region provided herein and a pharmaceutically acceptable carrier. In another embodiment, a pharmaceutical formulation comprises a polypeptide comprising a variant Fc region provided herein and at least one additional therapeutic agent.

In a further aspect, the pharmaceutical formulation is for treatment of a disorder. In one embodiment, the pharmaceutical formulation is administered to an individual having a disorder. In one embodiment, the "individual" is a human.

In further embodiments, the invention provides a polypeptide comprising a variant Fc region for use in suppressing the activation of B cells, mast cells, dendritic cells, and/or basophils. In certain embodiments, the invention provides a polypeptide comprising a variant Fc region for use in a method of suppressing the activation of B cells, mast cells, dendritic cells, and/or basophils in an individual comprising administering to the individual an effective amount of the polypeptide comprising a variant Fc region to suppress the activation of B cells, mast cells, dendritic cells, and/or basophils. In one embodiment, the "individual" is a human.

In a further aspect, the invention provides the use of a polypeptide comprising a variant Fc region in the manufacture or preparation of a medicament. In some aspects, the polypeptide is an antibody. In some aspects, the polypeptide is an Fc fusion protein. In a further embodiment, the medicament is for suppressing the activation of B cells, mast cells, dendritic cells, and/or basophils. In a further embodiment, the medicament is for use in a method of suppressing the activation of B cells, mast cells, dendritic cells, and/or basophils in an individual comprising administering to the individual an effective amount of the medicament to suppress the activation of B cells, mast cells, dendritic cells, and/or basophils. In one embodiment, the "individual" is a human.

In a further aspect, the invention provides a method for suppressing the activation of B cells, mast cells, dendritic cells, and/or basophils in an individual. In one embodiment, the method comprises administering to the individual an effective amount of a polypeptide comprising a variant Fc region to suppress the activation of B cells, mast cells, dendritic cells, and/or basophils. In one embodiment, the "individual" is a human.

In a further aspect, the invention provides pharmaceutical formulations comprising a polypeptide comprising a variant Fc sequence. In a further embodiment, the pharmaceutical formulation is for suppressing the activation of B cells, mast cells, dendritic cells, and/or basophils.

Polypeptides comprising a variant Fc region of the present invention can suppress the activation of B cells, mast cells, dendritic cells, and/or basophils. It has been reported that cross-linking of FcεRI with FcγRIIb on basophils using an anti-IgE antibody which has the potential to bind simultaneously to FcεRI-bound IgE, via its Fab regions, and the negative regulatory receptor, FcγRIIb, via its Fc region, leads to inhibition of basophil degranulation (*Clin. Exp. Allergy* 38: 313-319 (2008)). Without wishing to be bound by theory, it is believed that direct or indirect cross-linking of FcγRIIb with molecules that are expressed on B cells, mast cells, dendritic cells, and/or basophils (such as BCR, CD19, CD79b, FcεRI, DAP 12, and CD200R3) which comprise the ITAM domain inside the cell or interact with the ITAM domain can suppress the activation of those cells. Use of an antibody, for example, which comprises Fab regions which bind to the molecules described above and a variant Fc region of the present invention which selectively binds to FcγRIIb, is expected to cause the suppressive effects. As used herein, "B cell activation" includes proliferation, IgE production, IgM production, and IgA production. "activation of mast cells" includes proliferation, activation by IgE, and degranulation. "activation of basophils" includes proliferation and degranulation of basophils. "activation of dendritic cells" includes proliferation and degranulation of dendritic cells.

In some embodiments, the invention provides a method of suppressing the activation of an immune cell in a biological sample comprising contacting a biological sample containing an immune cell with a polypeptide comprising a variant Fc sequence (region) provided herein under conditions permissive for binding of the polypeptide to the immune cell, and suppressing the activation of the immune cell. In some embodiments, the immune cell is a B cell, mast cell, dendritic cell, or basophil. In some embodiments, the polypeptide contains a variant Fc sequence (region) comprising at least one amino acid alteration in a parent Fc region, wherein the ratio of [KD value of the parent Fc region for monkey FcγRIIb]/[KD value of the variant Fc region for monkey FcγRIIb] is 2.0 or greater, and the ratio of [KD value of the parent Fc region for monkey FcγRIIIa]/[KD value of the variant Fc region for monkey FcγRIIa] is 0.5 or smaller. In some embodiments, the polypeptide contains an Fc sequence (region) comprising at least two amino acid alterations of at least two positions selected from the group consisting of: 285, 311, 312, 315, 318, 333, 335, 337, 341, 342, 343, 384, 385, 388, 390, 399, 400, 401, 402, 413, 420, 422, and 431, according to EU numbering. In some embodiments, the polypeptide comprises the amino acid sequence of SEQ ID NO: 229-380, or 381.

In some embodiments, the invention provides a method of treating an individual having an immunological inflammatory disease, autoimmune disease, or viral infection comprising administering to the individual an effective amount of a polypeptide comprising a variant Fc sequence (region) provided herein. In some embodiments, the polypeptide contains a variant Fc sequence comprising at least one amino acid alteration in a parent Fc region, wherein the ratio of [KD value of the parent Fc region for monkey FcγRIIb]/[KD value of the variant Fc region for monkey FcγRIIb] is 2.0 or greater, and the ratio of [KD value of the parent Fc region for monkey FcγRIIIa]/[KD value of the variant Fc region for monkey FcγRIIa] is 0.5 or smaller. In some embodiments, the polypeptide contains an Fc sequence (region) comprising at least two amino acid alterations of at least two positions selected from the group consisting of: 285, 311, 312, 315, 318, 333, 335, 337, 341, 342, 343, 384, 385, 388, 390, 399, 400, 401, 402, 413, 420, 422, and 431, according to EU numbering. In some embodiments, the polypeptide comprises the amino acid sequence of SEQ ID NO: 229-380, or 381.

In further embodiments, the invention provides a polypeptide comprising a variant Fc sequence provided herein for use in treating an immunological inflammatory disease. In certain embodiments, the invention provides a polypeptide comprising a variant Fc sequence for use in a method of treating an immunological inflammatory disease in an individual comprising administering to the individual an effective amount of the polypeptide comprising a variant Fc sequence to treat an immunological inflammatory disease. In one embodiment, the "individual" is a human.

In a further aspect, the invention provides the use of a polypeptide comprising a variant Fc sequence provided herein in the manufacture or preparation of a medicament. In some aspects, the polypeptide is an antibody. In some aspects, the polypeptide is an Fc fusion protein. In a further embodiment, the medicament is for treating an immunological inflammatory disease. In a further embodiment, the medicament is for use in a method of treating an immunological inflammatory disease in an individual comprising administering to the individual an effective amount of the medicament to treat immunological inflammatory diseases. An "individual" according to any of the above embodiments may be a human.

In a further aspect, the invention provides a method for treating an immunological inflammatory disease in an individual. In one embodiment, the method comprises administering to the individual an effective amount of a polypeptide comprising a variant Fc region to treat immunological inflammatory diseases. In one embodiment, an "individual" is a human.

In a further aspect, the invention provides pharmaceutical formulations comprising any of the polypeptides comprising a variant Fc region provided herein. In a further embodiment, the pharmaceutical formulation is for treating an immunological inflammatory disease.

As described above, since polypeptides comprising a variant Fc region of the present invention can suppress activation of B cells, mast cells, dendritic cells and/or basophils, administration of the polypeptides comprising a variant Fc region of the present invention as a result can treat or prevent immunological inflammatory diseases.

In certain embodiments, the treated immunological inflammatory disease is selected from the group consisting of rheumatoid arthritis, autoimmune hepatitis, autoimmune thyroiditis, autoimmune blistering diseases, autoimmune adrenocortical disease, autoimmune hemolytic anemia, autoimmune thrombocytopenic purpura, megalocytic anemia, autoimmune atrophic gastritis, autoimmune neutropenia, autoimmune orchitis, autoimmune encephalomyelitis, autoimmune receptor disease, autoimmune infertility, chronic active hepatitis, glomerulonephritis, interstitial pulmonary fibrosis, multiple sclerosis, Paget's disease, osteoporosis, multiple myeloma, uveitis, acute and chronic spondylitis, gouty arthritis, inflammatory bowel disease, adult respiratory distress syndrome (ARDS), psoriasis, Crohn's disease, Basedow's disease, juvenile diabetes, Addison's disease, myasthenia gravis, lens-induced uveitis, systemic lupus erythematosus, allergic rhinitis, allergic dermatitis, ulcerative colitis, hypersensitivity, muscle degeneration, cachexia, systemic scleroderma, localized scleroderma, Sjogren's syndrome, Behchet's disease, Reiter's syndrome, type I and type II diabetes, bone resorption disorder, graft-versus-host reaction, ischemia-reperfusion injury, atherosclerosis, brain trauma, cerebral malaria, sepsis, septic shock, toxic shock syndrome, fever, malgias due to staining, aplastic anemia, hemolytic anemia, idiopathic thrombocytopenia, Goodpasture's syndrome, Guillain-Barre syndrome, Hashimoto's thyroiditis, pemphigus, IgA nephropathy, pollinosis, antiphospholipid antibody syndrome, polymyositis, Wegener's granulomatosis, arteritis nodosa, mixed connective tissue disease, fibromyalgia, asthma, atopic dermatitis, chronic atrophic gastritis, primary biliary cirrhosis, primary sclerosing cholangitis, autoimmune pancreatitis, aortitis syndrome, rapidly progressive glomerulonephritis, megaloblastic anemia, idiopathic thrombocytopenic purpura, primary hypothyroidism, idiopathic Addison's disease, insulin-dependent diabetes mellitus, chronic discoid lupus erythematosus, pemphigoid, herpes gestationis, linear IgA bullous dermatosis, epidermolysis bullosa acquisita, alopecia areata, vitiligo vulgaris, leukoderma acquisitum centrifugum of Sutton, Harada's disease, autoimmune optic neuropathy, idiopathic azoospermia, habitual abortion, hypoglycemia, chronic urticaria, ankylosing spondylitis, psoriatic arthritis, enteropathic arthritis, reactive arthritis, spondyloarthropathy, enthesopathy, irritable bowel syndrome, chronic fatigue syndrome, dermatomyositis, inclusion body myositis, Schmidt's syndrome, Graves' disease, pernicious anemia, lupoid hepatitis, presenile dementia, Alzheimer's disease, demyelinating disorder, amyotrophic lateral sclerosis, hypoparathyroidism, Dressler's syndrome, Eaton-Lambert syndrome, dermatitis herpetiformis, alopecia, progressive systemic sclerosis, CREST syndrome (calcinosis, Raynaud's phenomenon, esophageal dysmotility, sclerodactyly, and telangiectasia), sarcoidosis, rheumatic fever, erythema multiforme, Cushing's syndrome, transfusion reaction, Hansen's disease, Takayasu arteritis, polymyalgia rheumatica, temporal arteritis, giant cell arthritis, eczema, lymphomatoid granulomatosis, Kawasaki disease, endocarditis, endomyocardial fibrosis, endophthalmitis, fetal erythroblastosis, eosinophilic fasciitis, Felty syndrome, Henoch-Schonlein purpura, transplant rejection, mumps, cardiomyopathy, purulent arthritis, familial Mediterranean fever, Muckle-Wells syndrome, and hyper-IgD syndrome.

In further embodiments, the invention provides a polypeptide comprising a variant Fc region for use in treating or preventing an autoimmune diseases which may be caused or associated with the production of antibodies against autoantigens (autoantibodies). In certain embodiments, the invention provides a polypeptide comprising a variant Fc region for use in a method of treating or preventing an autoimmune disease which may be caused by, or associated with, the production of antibodies against an autoantigen (autoantibody) in an individual comprising administering to the individual an effective amount of the polypeptide comprising a variant Fc region to treat or prevent the autoimmune disease. An "individual" according to any of the above embodiments is preferably a human.

In a further aspect, the invention provides the use of a polypeptide comprising a variant Fc region in the manufacture or preparation of a medicament. In some aspects, the polypeptide is an antibody. In some aspects, the polypeptide is an Fc fusion protein. In a further embodiment, the medicament is for treating or preventing an autoimmune disease which may be caused by production of antibodies against autoantigens (autoantibodies). In a further embodiment, the medicament is for use in a method of treating or preventing an autoimmune disease that is associated with production of antibodies against autoantigens (autoantibodies) in an individual comprising administering to the individual an effective amount of the medicament to treat or prevent the autoimmune disease. An "individual" according to any of the above embodiments may be a human.

In a further aspect, the invention provides a method for treating or preventing autoimmune diseases which may be caused by production of antibodies against autoantigens (autoantibodies) in an individual. In one embodiment, the method comprises administering to the individual an effective amount of a polypeptide comprising a variant Fc region to treat or prevent the autoimmune disease. In one embodiment, an "individual" is a human.

In a further aspect, the invention provides pharmaceutical formulations comprising any of the polypeptides comprising a variant Fc region provided herein. In a further embodiment, the pharmaceutical formulation is for treating or preventing an autoimmune disease which may be caused by production of antibodies against an autoantigen (autoantibodies).

The polypeptides comprising a variant Fc region of the present invention can treat or prevent an autoimmune disease which may be caused by production of antibodies against an autoantigen (autoantibodies) by suppressing production of those autoantibodies. Use of a fusion molecule of an antibody Fc portion with AchR (an autoantigen of myasthenia gravis) has been reported to suppress proliferation of B cells which express AchR-recognizing BCR, and induce apoptosis (*J. Neuroimmunol* 227: 35-43 (2010)). Use of a fusion protein formed between a variant Fc region of the present invention and an antigen recognized by an autoantibody enables crosslinking of FcγRIIb with BCR for that autoantigen on a B cell, which causes suppression of proliferation and induction of apoptosis of the B cells.

In certain embodiments, an autoimmune disease that can be treated or prevented is selected from the group consisting of Guillain-Barre syndrome, myasthenia gravis, chronic atrophic gastritis, autoimmune hepatitis, primary biliary cirrhosis, primary sclerosing cholangitis, autoimmune pancreatitis, aortitis syndrome, Goodpasture's syndrome, rapidly progressive glomerulonephritis, megaloblastic anemia, autoimmune hemolytic anemia, autoimmune neutropenia, idiopathic thrombocytopenic purpupura, Basedow's disease, Hashimoto's thyroiditis, primary hypothyroidism, idiopathic Addison's disease, insulin-dependent diabetes mellitus, chronic discoid lupus erythematosus, localized scleroderma, pemphigus, pemphigoid, herpes gestationis, linear IgA bullous dermatosis, epidermolysis bullosa acquisita, alopecia areata, vitiligo vulgaris, leukoderma acquisitum centrifugum of Sutton, Harada's disease, autoimmune optic neuropathy, idiopathic azoospermia, habitual abortion, type II diabetes, hypoglycemia, and chronic urticaria.

In further embodiments, the invention provides a polypeptide comprising a variant Fc region for use in treating a disease associated with a deficiency of a biologically essential protein. In certain embodiments, the invention provides a polypeptide comprising a variant Fc region for use in a method of treating a disease associated with a deficiency of a biologically essential protein in an individual comprising administering to the individual an effective amount of the polypeptide comprising a variant Fc region to treat the disease. An "individual" according to any of the above embodiments is preferably a human.

In a further aspect, the invention provides the use of a polypeptide comprising a variant Fc region in the manufacture or preparation of a medicament. In some aspects, the polypeptide is an antibody. In some aspects, the polypeptide is an Fc fusion protein. In a further embodiment, the medicament is for treating a disease associated with a deficiency of a biologically essential protein. In a further embodiment, the medicament is for use in a method of treating a disease associated with a deficiency of a biologically essential protein in an individual comprising administering to the individual an effective amount of the medicament to treat the disease. An "individual" according to any of the above embodiments may be a human.

In a further aspect, the invention provides a method for treating a disease associated with a deficiency of a biologically essential protein in an individual. In one embodiment, the method comprises administering to the individual an effective amount of a polypeptide comprising a variant Fc region to treat the disease. In one embodiment, an "individual" is a human.

In a further aspect, the invention provides pharmaceutical formulations comprising any of the polypeptides comprising a variant Fc region provided herein. In a further embodiment, the pharmaceutical formulation is for treating a disease associated with a deficiency of a biologically essential protein.

For diseases with deficiency of a biologically essential protein, therapeutic methods that administer and supplement the protein as a pharmaceutical agent are used. However, since the patient lacks the protein from the beginning, the externally supplemented protein is recognized as a foreign substance and antibodies against that protein are produced. As a result, the protein becomes easily removed, and the effect as a pharmaceutical is reduced. Use of a fusion protein comprising such a protein and a variant Fc region of the present invention enables crosslinking between FcγRIIb and BCR that recognizes the protein on B cells, which causes suppression of antibody production against the protein.

In certain embodiments, the protein to be supplemented is selected from the group consisting of Factor VIII, Factor IX, TPO, EPO, α-iduronidase, iduronate sulfatase, A-type heparan N-sulfatase, B type α-N-acetylglucosaminidase, C type acetyl CoA: α-glucosaminidase acetyltransferase, D type N-acetylglucosamine 6-sulfatase, galactose 6-sulfatase, N-acetylgalactosamine 4-sulfatase, β-glucuronidase, α-galactosidase, acidic α-galactosidase, and glucocerebrosidase. These proteins may be supplemented for diseases such as hemophilia, idiopathic thrombocytopenic purpura, renal anemia, and lysosomal disease (mucopolysaccharidosis, Fabry's disease, Pompe disease, and Gaucher's disease), without being limited thereto.

In further embodiments, the invention provides a polypeptide comprising a variant Fc region for use in treating a viral infection. In certain embodiments, the invention provides a polypeptide comprising a variant Fc region for use in a method of treating a viral infection in an individual comprising administering to the individual an effective amount of the polypeptide comprising a variant Fc region to treat a viral infection. An "individual" according to any of the above embodiments is preferably a human.

In a further aspect, the invention provides the use of a polypeptide comprising a variant Fc region provided herein in the manufacture or preparation of a medicament. In some aspects, the polypeptide is an antibody. In some aspects, the polypeptide is an Fc fusion protein. In a further embodiment, the medicament is for treating a viral infection. In a further embodiment, the medicament is for use in a method of treating a viral infection in an individual comprising administering to the individual an effective amount of the medicament to treat a viral infection. An "individual" according to any of the above embodiments may be a human.

In a further aspect, the invention provides a method for treating a viral infection in an individual. In one embodiment, the method comprises administering to the individual an effective amount of a polypeptide comprising a variant Fc region to treat a viral infection. In one embodiment, an "individual" is a human.

In a further aspect, the invention provides pharmaceutical formulations comprising any of the polypeptides comprising a variant Fc region provided herein. In a further embodiment, the pharmaceutical formulation is for treating a viral infection.

Anti-virus antibodies that comprise a variant Fc region of the present invention can suppress antibody-dependent enhancement observed with conventional anti-virus antibodies. Antibody-dependent enhancement is a phenomenon where a virus bound to an antibody is phagocytosed via activating FcγRs so that infection of the virus to a cell is enhanced. Binding of anti-dengue-virus antibodies to FcγRIIb has been reported to play an important role in suppressing antibody-dependent enhancement (*Proc. Natl. Acad. Sci. USA* 108:12479-12484, (2011)). Crosslinking FcγRIIb molecules by an immune complex of the anti-dengue-virus antibodies and dengue virus, inhibits FcγR-mediated phagocytosis, resulting in the suppression of antibody-dependent enhancement. Examples of such viruses include dengue virus (DENV1, DENV2, DENV3, and DENV4) and HIV, but are not limited thereto.

In further embodiments, the invention provides a polypeptide comprising a variant Fc region for use in preventing or treating arteriosclerosis. In certain embodiments, the invention provides a polypeptide comprising a variant Fc region for use in a method of preventing or treating arteriosclerosis in an individual comprising administering to the individual an effective amount of the polypeptide comprising a variant Fc region to prevent or treat arteriosclerosis. In some aspects, the polypeptide is an antibody. In some aspects, the polypeptide is an Fc fusion protein. An "individual" according to any of the above embodiments is preferably a human.

In a further aspect, the invention provides the use of a polypeptide comprising a variant Fc region in the manufacture or preparation of a medicament. In some aspects, the polypeptide is an antibody. In some aspects, the polypeptide is an Fc fusion protein. In a further embodiment, the medicament is for preventing or treating arteriosclerosis. In a further embodiment, the medicament is for use in a method of preventing or treating arteriosclerosis in an individual comprising administering to the individual an effective amount of the medicament to prevent or treat arteriosclerosis. An "individual" according to any of the above embodiments may be a human.

In a further aspect, the invention provides a method for preventing or treating arteriosclerosis in an individual. In one embodiment, the method comprises administering to the individual an effective amount of a polypeptide comprising a variant Fc region to prevent or treat arteriosclerosis. In one embodiment, an "individual" is a human.

In a further aspect, the invention provides pharmaceutical formulations comprising any of the polypeptides comprising a variant Fc region provided herein. In some aspects, the polypeptide is an antibody. In some aspects, the polypeptide is an Fc fusion protein. In a further embodiment, the pharmaceutical formulation is for preventing or treating arteriosclerosis.

Antibodies against oxidized LDL, i.e., a cause for arteriosclerosis, comprising a variant Fc region of the present invention can prevent FcγRIIa-dependent adhesion of inflammatory cells. It has been reported that while anti-oxidized LDL antibodies inhibit the interaction between oxidized LDL and CD36, anti-oxidized LDL antibodies bind to endothelial cells, and monocytes recognize their Fc portion in an FcγRIIa-dependent or FcγRI-dependent manner (*Immunol. Lett.* 108:52-61, (2007)). Using antibodies comprising a variant Fc region of the present invention may inhibit FcγRIIa-dependent binding and suppress monocyte adhesion by FcγRIIb-mediated inhibitory signals.

In further embodiments, the invention provides a polypeptide comprising a variant Fc region for use in preventing or treating cancer. In certain embodiments, the invention provides a polypeptide comprising a variant Fc region for use in a method of preventing or treating cancer in an individual comprising administering to the individual an effective amount of the polypeptide comprising a variant Fc region to prevent or treat cancer. An "individual" according to any of the above embodiments is preferably a human.

In a further aspect, the invention provides the use of a polypeptide comprising a variant Fc region provided herein in the manufacture or preparation of a medicament. In some aspects, the polypeptide is an antibody. In some aspects, the polypeptide is an Fc fusion protein. In a further embodiment, the medicament is for preventing or treating cancer. In a further embodiment, the medicament is for use in a method of preventing or treating cancer in an individual comprising administering to the individual an effective amount of the medicament to prevent or treat cancer. An "individual" according to any of the above embodiments may be a human.

In a further aspect, the invention provides a method for preventing or treating cancer in an individual. In one embodiment, the method comprises administering to the individual an effective amount of a polypeptide comprising a variant Fc region to prevent or treat cancer. In some aspects, the polypeptide is an antibody. In some aspects, the polypeptide is an Fc fusion protein. In one embodiment, an "individual" is a human.

In a further aspect, the invention provides pharmaceutical formulations comprising any of the polypeptides comprising a variant Fc region provided herein. In some aspects, the polypeptide is an antibody. In some aspects, the polypeptide is an Fc fusion protein. In a further embodiment, the pharmaceutical formulation is for preventing or treating cancer.

As described above, it is known that enhancing the FcγRIIb binding increases the agonistic activity of an agonist antibody, and enhances the antitumor effect of the antibody. Therefore, agonist antibodies comprising a variant Fc region of the present invention are useful for treatment or prevention of cancer. Specifically, a variant Fc region of the present invention enhances the agonistic activity of antibodies against, for example, receptors of the TNF receptor family such as, CD120a, CD120b, Lymphotoxin β receptor, CD134, CD40, FAS, TNFRSF6B, CD27, CD30, CD137, TNFRSF10A, TNFRSF10B, TNFRSF10C, TNFRSF10D, RANK, Osteoprotegerin, TNFRSF12A, TNFRSF13B, TNFRSF3C, TNFRSF14, Nerve growth factor receptor, TNFRSF17, TNFRSF18, TNFRSF19, TNFRSF21, TNFRSF25, and Ectodysplasin A2 receptor, and can be used for treating or preventing cancer. Furthermore, agonistic activity is also enhanced for antibodies against other molecules, which exhibit agonistic activity through interaction with FcγRIIb. In addition, by incorporating a variant Fc region of the present invention into an antibody against a receptor tyrosine kinase (RTK) such as Kit, which suppresses cell proliferation upon crosslinking with FcγRIIb, the inhibitory effect of the antibody against cell proliferation may be enhanced.

In some embodiments, the invention provides a method for preventing or treating a cancer including but not limited to a member selected from: small cell lung cancer, non-small cell lung cancer, pulmonary adenocarcinoma, and squamous cell carcinoma of the lung), large intestine cancer, rectal cancer, colon cancer, breast cancer, liver cancer, gastric cancer, pancreatic cancer, renal cancer, prostate cancer, ovarian cancer, thyroid cancer, cholangiocarcinoma, peritoneal cancer, mesothelioma, squamous cell carcinoma, cervical cancer, endometrial cancer, bladder cancer, esophageal cancer, head and neck cancer, nasopharyngeal cancer, salivary gland tumor, thymoma, skin cancer, basal cell tumor, malignant melanoma, anal cancer, penile cancer, testicular cancer, Wilms' tumor, acute myeloid leukemia (including acute myeloleukemia, acute myeloblastic leukemia, acute promyelocytic leukemia, acute myelomonocytic leukemia, and acute monocytic leukemia), chronic myelogenous leukemia, acute lymphoblastic leukemia, chronic lymphatic leukemia, Hodgkin's lymphoma, non-Hodgkin's lymphoma (Burkitt's lymphoma, chronic lymphocytic leukemia, mycosis fungoides, mantle cell lymphoma, follicular lymphoma, diffuse large-cell lymphoma, marginal zone lymphoma, pilocytic leukemia plasmacytoma, peripheral T-cell lymphoma, and adult T cell leukemiallymphoma), Langerhans cell histiocytosis, multiple myeloma, myelodysplastic syndrome, brain tumor (including glioma, astroglioma, glioblastoma, meningioma, and ependymoma), neuroblastoma, retinoblastoma, osteosarcoma, Kaposi's sarcoma, Ewing's sarcoma, angiosarcoma, and hemangiopericytoma.

Antibodies which have been modified to have enhanced binding activity to FcγRs including FcγRIIb by modification of at least one amino acid residue can promote antigen elimination from the plasma, as described or suggested in, for example, WO 2013/047752, WO 2013/125667, WO 2014/030728, or WO 2014/163101.

Without being bound by a particular theory, an antibody having an increased FcγR-binding activity under a neutral pH condition is rapidly taken up into cells together with its antigen complexed with the antibody, and as a result, antigen elimination from plasma can be promoted when the antibody is administered in vivo.

Antibodies which have been modified to have an increased pI by modification of at least one amino acid residue that are exposed on the antibody surface can be incorporated more rapidly into cells or can promote antigen elimination from the plasma, as described or suggested in, for example, WO 2007/114319, WO 2009/041643, WO 2014/145159, or WO 2012/016227.

Without being bound by a particular theory, it is believed that the pH of biological fluids (for example, plasma) is in a neutral pH range. In biological fluids, the net positive charge of a pI-increased antibody is increased due to the increased pI, and as a result the antibody is more strongly attracted by physicochemical Coulomb interaction to the endothelial cell surface that has a net negative charge compared to an antibody not having an increased pI. That means, via such non-specific binding, uptake into cells of the antibody complexed with its antigen is enhanced, which results in enhancement of antigen elimination from plasma. These phenomena are expected to occur commonly in vivo, regardless of cell type, tissue type, organ type, etc.

Herein, enhancement of antigen elimination from plasma means, for example, that the rate of antigen elimination from plasma is increased as compared to that when a polypeptide comprising a corresponding Fc region that has not been so modified has been administered. The increase of antigen elimination from plasma can be assessed, for example, by measuring the concentration of the antigen in plasma. Various methods for measuring antigen concentration in plasma are known in the art.

In further embodiments, the invention provides a polypeptide comprising a variant Fc region for use in promoting elimination of an antigen from plasma. In certain embodiments, the invention provides a polypeptide comprising a variant Fc region for use in a method of promoting elimination of an antigen from plasma in an individual comprising administering to the individual an effective amount of the polypeptide comprising a variant Fc region to promote elimination of an antigen from plasma. In those embodiments, it is preferable that the polypeptide further comprises an antigen-binding domain. An "individual" according to any of the above embodiments is preferably a human.

In a further aspect, the invention provides the use of a polypeptide comprising a variant Fc region in the manufacture or preparation of a medicament. In some aspects, the polypeptide is an antibody. In some aspects, the polypeptide is an Fc fusion protein. In a further embodiment, the medicament is for promoting elimination of an antigen from plasma. In a further embodiment, the medicament is for use in a method of promoting elimination of an antigen from plasma in an individual comprising administering to the individual an effective amount of the medicament to promote elimination of an antigen from plasma. In those embodiments, it is preferable that the polypeptide further comprises an antigen-binding domain. An "individual" according to any of the above embodiments may be a human.

In a further embodiment, the invention provides a method for promoting elimination of an antigen from plasma in an individual. In one embodiment, the method comprises administering to the individual an effective amount of a polypeptide comprising a variant Fc region to promote elimination of an antigen from plasma. In those embodiments, it is preferable that the polypeptide further comprises an antigen-binding domain. In one embodiment, an "individual" is a human.

In a further aspect, the invention provides pharmaceutical formulations comprising any of the polypeptides comprising a variant Fc region provided herein. In a further embodiment, the pharmaceutical formulation is for promoting elimination of an antigen from plasma. In that embodiment, it is preferable that the polypeptide further comprises an antigen-binding domain.

In one embodiment, when compared to before amino acid modification, an antibody having a variant Fc region of the present invention enhances antigen elimination from plasma, for example, by at least 1.1-fold, 1.25-fold, 1.5-fold, 1.75-fold, 2.0-fold, 2.25-fold, 2.5-fold, 2.75-fold, 3.0-fold, 3.25-fold, 3.5-fold, 3.75-fold, 4.0-fold, 4.25-fold, 4.5-fold, 4.75-fold, 5.0-fold, 5.5-fold, 6.0-fold, 6.5-fold, 7.0-fold, 7.5-fold, 8.0-fold, 8.5-fold, 9.0-fold, 9.5-fold, or 10.0-fold or more, when the antibody is administered in vivo.

In a further aspect, the invention provides methods for preparing a medicament or a pharmaceutical formulation, comprising mixing any of the polypeptides comprising a variant Fc region provided herein with a pharmaceutically acceptable carrier, e.g., for use in any of the above therapeutic methods. In one embodiment, the methods for preparing a medicament or a pharmaceutical formulation further comprise adding at least one additional therapeutic agent to the medicament or pharmaceutical formulation.

Antibodies of the invention can be used either alone or in combination with other agents in a therapy. For instance, an antibody of the invention may be co-administered with at least one additional therapeutic agent.

Likewise, polypeptides comprising a variant Fc region of the invention can be used either alone or in combination with other agents in a therapy. For instance, a polypeptide comprising a variant Fc region of the invention may be co-administered with at least one additional therapeutic agent.

Such combination therapies noted above encompass combined administration (where two or more therapeutic agents are included in the same or separate formulations), and separate administration, in which case, administration of the antibody or polypeptide comprising a variant Fc region of the invention can occur prior to, simultaneously, and/or following, administration of the additional therapeutic agent or agents. In one embodiment, the administration of the anti-myostatin antibody and the administration of an additional therapeutic agent occur within about one month, or within about one, two or three weeks, or within about one, two, three, four, five, or six days, of each other.

In another embodiment, the administration of the polypeptide comprising the variant Fc region and the administration of an additional therapeutic agent occur within about one month, or within about one, two or three weeks, or within about one, two, three, four, five, or six days, of each other.

An antibody or a polypeptide comprising a variant Fc region of the invention (and optionally any additional therapeutic agent) can be administered by any suitable means, including parenteral, intrapulmonary, and intranasal, and, if desired for local treatment, intralesional administration. Parenteral infusions include intramuscular, intravenous, intraarterial, intraperitoneal, or subcutaneous administration. Dosing can be by any suitable route, e.g., by injections, such as intravenous or subcutaneous injections, depending in part on whether the administration is brief or chronic. Various dosing schedules including but not limited to single or multiple administrations over various time-points, bolus administration, and pulse infusion are contemplated herein.

Antibodies or polypeptides comprising a variant Fc region of the invention can be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners. The antibody need not be, but is optionally formulated with one or more agents currently used to prevent or treat the disorder in question. The effective amount of such other agents depends on the amount of antibody present in the formulation, the type of disorder or treatment, and other factors discussed above. These are generally used in the same dosages and with administration routes as described herein, or about from 1 to 99% of the dosages described herein, or in any dosage and by any route that is empirically/clinically determined to be appropriate.

For the prevention or treatment of disease, the appropriate dosage of an antibody of the invention (when used alone or in combination with one or more other additional therapeutic agents) will depend on the type of disease to be treated, the type of antibody, the type of polypeptide comprising a variant Fc region, the severity and course of the disease, whether the antibody or polypeptide comprising the variant Fc region, is administered for preventive or therapeutic purposes, previous therapy, the patient's clinical history and response to the antibody or polypeptide comprising the variant Fc region, and the discretion of the attending physician. The antibody or polypeptide comprising a variant Fc region of the invention is suitably administered to the patient at one time or over a series of treatments. Depending on the type and severity of the disease, about 1 µg/kg to 15 mg/kg (e.g., 0.1 mg/kg-10 mg/kg) of antibody can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. One exemplary dosage of the antibody or polypeptide comprising the variant Fc region would be in the range from about 0.05 mg/kg to about 10 mg/kg. Thus, one or more doses of about 0.5 mg/kg, 2.0 mg/kg, 4.0 mg/kg or 10 mg/kg (or any combination thereof) may be administered to the patient. Such doses may be administered intermittently, e.g., every week or every three weeks (e.g., such that the patient receives from about two to about twenty, or e.g., about six doses of the antibody or polypeptide comprising the variant Fc region). An initial higher loading dose, followed by one or more lower doses may be administered. The progress of this therapy is easily monitored by conventional techniques and assays.

It is understood that any of the above formulations or therapeutic methods may be carried out using an immunoconjugate of the invention in place of or in addition to an anti-myostatin antibody.

It is likewise understood that any of the above formulations or therapeutic methods may be carried out using an immunoconjugate of the invention in place of or in addition to a polypeptide comprising a variant Fc region provided herein.

H. Articles of Manufacture

In another aspect of the invention, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper pierceable by a hypodermic injection needle). At least one active agent in the composition is an antibody of the invention. The label or package insert indicates that the composition is used for treating the condition of choice. Moreover, the article of manufacture may comprise (a) a first container with a composition contained therein, wherein the composition comprises an antibody of the invention; and (b) a second container with a composition contained therein, wherein the composition comprises a further cytotoxic or otherwise therapeutic agent. The article of manufacture in this embodiment of the invention may further comprise a package insert indicating that the compositions can be used to treat a particular condition. Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

It is understood that any of the above articles of manufacture may include an immunoconjugate of the invention in place of or in addition to an anti-myostatin antibody.

EXAMPLES

The following are examples of methods and compositions of the invention. It is understood that various other embodiments may be practiced, given the general description provided above.

Example 1

Expression and Purification of Human, Cynomolgus Monkey, and Mouse Myostatin Latent and Mature Form Human latent myostatin (also described herein as human myostatin latent form) (SEQ ID NO: 1) was expressed transiently using FREESTYLE®293 cells (FS293-F cells) (Thermo Fisher, Carlsbad, Calif., USA). Conditioned media containing expressed human myostatin latent form was acidified to pH6.8 and diluted with ½ vol of milliQ water, followed by application to a Q-sepharose FF anion exchange column (GE healthcare, Uppsala, Sweden). The flow-through fraction was adjusted to pH5.0 and applied to a SP-sepharose HP cation exchange column (GE healthcare, Uppsala, Sweden), and then eluted with a NaCl gradient. Fractions containing the human myostatin latent form were collected and subsequently subjected to a SUPERDEX® 200 gel filtration column (GE healthcare, Uppsala, Sweden) equilibrated with 1×PBS. Fractions containing the human myostatin latent form were then pooled and stored at −80° C.

Human mature myostatin (also described herein as human myostatin mature form) (SEQ ID NO: 2) was purified from the purified human myostatin latent form. The human myostatin latent form was acidified by addition of 0.1% trifluoroacetic acid (TFA) and applied to a Vydac 214TP C4 reverse phase column (Grace, Deerfield, Ill., USA) and eluted with a TFA/CH$_3$CN gradient. Fractions containing human mature myostatin were pooled, dried and stored at −80° C. To reconstitute, human mature myostatin was dissolved in 4 mM HCl.

Expression and purification of myostatin latent and mature form from cynomolgus monkey (cynomolgus or cyno) (SEQ ID NOs: 3 and 4, respectively) and mouse (SEQ ID NOs: 5 and 6, respectively) were all performed exactly the same way as the human counterpart. The sequence homology of mature form among human, cyno, and mouse are 100% identical, therefore, any of mature myostatin regardless of species were used as mature myostatin in all the necessary experiments.

Example 2

Identification of Anti-Latent Myostatin Antibody

Anti-latent myostatin antibodies were prepared, selected, and assayed as follows.

Twelve to sixteen week old NZW rabbits were immunized intradermally with mouse latent myostatin and/or human latent myostatin (50-100 μg/dose/rabbit). This dose was repeated 3-4 times over a one month period. One week after the final immunization, the spleen and blood from the immunized rabbit were collected. Antigen-specific B-cells were stained with labelled antigen, sorted with FCM cell sorter (FACS aria III, BD), and plated in 96-well plates at a one cell/well density together with 25,000 cells/well of EL4 cells (European Collection of Cell Cultures) and with rabbit T-cell conditioned medium diluted 20 times, and were cultured for 7-12 days. EL4 cells were treated with mitomycin C (Sigma) for 2 hours and washed 3 times in advance. The rabbit T-cell conditioned medium was prepared by culturing rabbit thymocytes in RPMI-1640 containing Phytohemagglutinin-M (Roche), phorbol 12-myristate 13-acetate (Sigma) and 2% FBS. After cultivation, B-cell culture supernatants were collected for further analysis and pellets were cryopreserved.

An ELISA assay was used to test the specificity of antibodies in a B-cell culture supernatant. Streptavidin (GeneScript) was coated onto a 384-well MAXISORP™ (Nunc) at 50 nM in PBS for 1 hour at room temperature. Plates were then blocked with Blocking One (Nacalai Tesque) diluted 5 times. Human or mouse latent myostatin was labelled with NHS-PEG4-Biotin (PIERCE) and was added to the blocked ELISA plates, incubated for 1 hour, and washed with Tris-buffered saline with 0.05% TWEEN® 20 (TBS-T). B-cell culture supernatants were added to the ELISA plates, incubated for 1 hour, and washed with TBS-T. Binding was detected by goat anti-rabbit IgG-horseradish peroxidase (BETHYL) followed by the addition of ABTS (KPL).

A total of 17,818 B-cell lines were screened for binding specificity to mouse and/or human latent myostatin and 299 lines were selected and designated MST0255-287, 630-632, 677-759, 910, 932-1048, 1050-1055, 1057-1066, 1068, 1070-1073, 1075-1110, 1113-1119. RNA was purified from corresponding cell pellets using ZR-96 Quick-RNA kits (ZYMO RESEARCH).

DNA encoding the variable regions of the heavy and light chain of each selected cell line was amplified by reverse transcription PCR and cloned into expression vectors with the heavy chain constant region G1m sequence (SEQ ID NO: 50 (the amino acid sequence is shown in SEQ ID NO: 7)) and with the light chain constant region k0MTC or k0MC sequence (SEQ ID NO: 53 or 194 (the amino acid sequence (both are the same) is shown in SEQ ID NO: 8)), respectively. Recombinant antibodies were expressed transiently using the FREESTYLE® FS293-F cells and 293FECTIN™ (Life technologies), according to the manufacturer's instructions. Culture supernatant or recombinant antibodies were used for screening. Recombinant antibodies were purified with protein A (GE Healthcare) and eluted in D-PBS or His buffer (20 mM Histidine, 150 mM NaCl, pH6.0). Size exclusion chromatography was further conducted to remove high molecular weight and/or low molecular weight component, if necessary.

Example 3

Characterization of Anti-Latent Myostatin Antibody (HEK Blue Assay (BMP1 Activation))

A reporter gene assay was used to assess the biological activity of active myostatin in vitro. HEK-Blue™ TGF-β cells (Invivogen) which express a Smad3/4-binding elements (SBE)-inducible SEAP reporter genes, allow the detection of bioactive myostatin by monitoring the activation of the activin type 1 and type 2 receptors. Active myostatin stimulates the production of SEAP which is secreted into the cell supernatant. The quantity of SEAP secreted is then assessed using QUANTIBlue™ (Invivogen).

Figure 1:
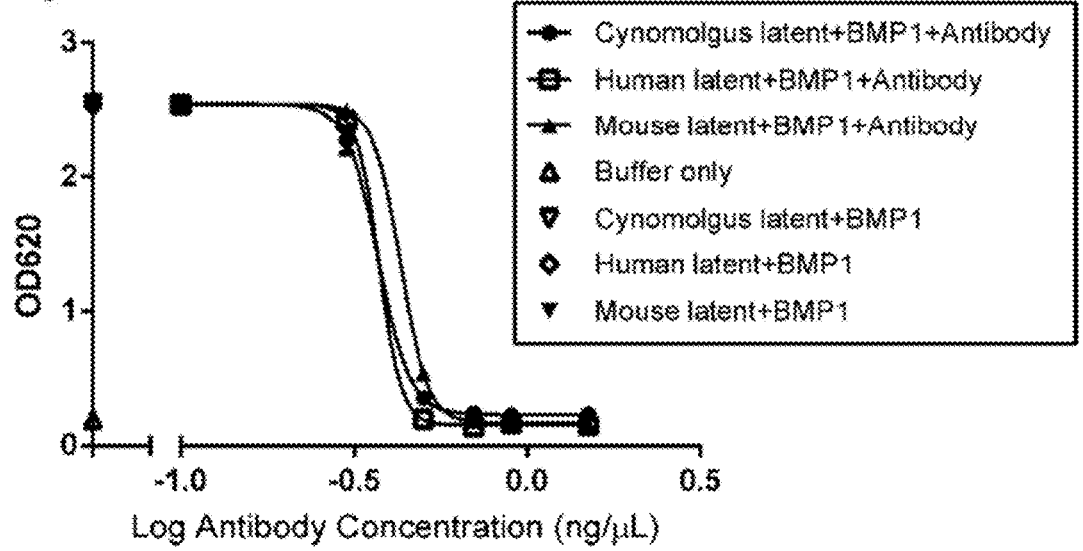
FIG. 1 illustrates inhibition of proteolytic activation of latent myostatin by anti-latent myostatin antibody, as described in Example 3. The activity of active myostatin released from latent myostatin by BMP1 protease was measured in the presence of anti-latent myostatin antibody, using HEK Blue Assay.

HEK-Blue™ TGF-β cells were maintained in DMEM medium (Gibco) supplemented with 10% fetal bovine serum, 50 μg/mL streptomycin, 50 U/mL penicillin, 100 μg/mL Normocin™, 301 μg/mL of Blasticidin, 200 μg/mL of HygroGold™ and 100 μg/mL of Zeocin™. During the functional assay, cells were changed to assay medium (DMEM with 0.1% bovine serum albumin, streptomycin, penicillin and Normocin™) and seeded to a 96-well plate. Human, cynamolgus, or mouse latent myostatin was incubated with recombinant human BMP1 (R&D Systems) and anti-latent antibody at 37° C. overnight. The sample mixtures were transferred to cells. After 24-hour incubation, the cell supernatants were mixed with QUANTIBlue™ and the optical density at 620 nm was measured in a colorimetric plate reader. As shown as FIG. 1, mAb MST1032-Glm (see Table 2a for amino acid and nucleotide sequences) prevented protease-mediated activation of human, cynomolgus, and mouse latent myostatin, as reflected by lowered concentrations of secreted SEAP. MST1032-Glm showed almost comparable inhibition activity against human, cynomolgus, and mouse latent myostatin.

Example 4

Characterization of Anti-Latent Myostatin Antibody (HEK Blue Assay (Spontaneous Activation))

Figure 2:
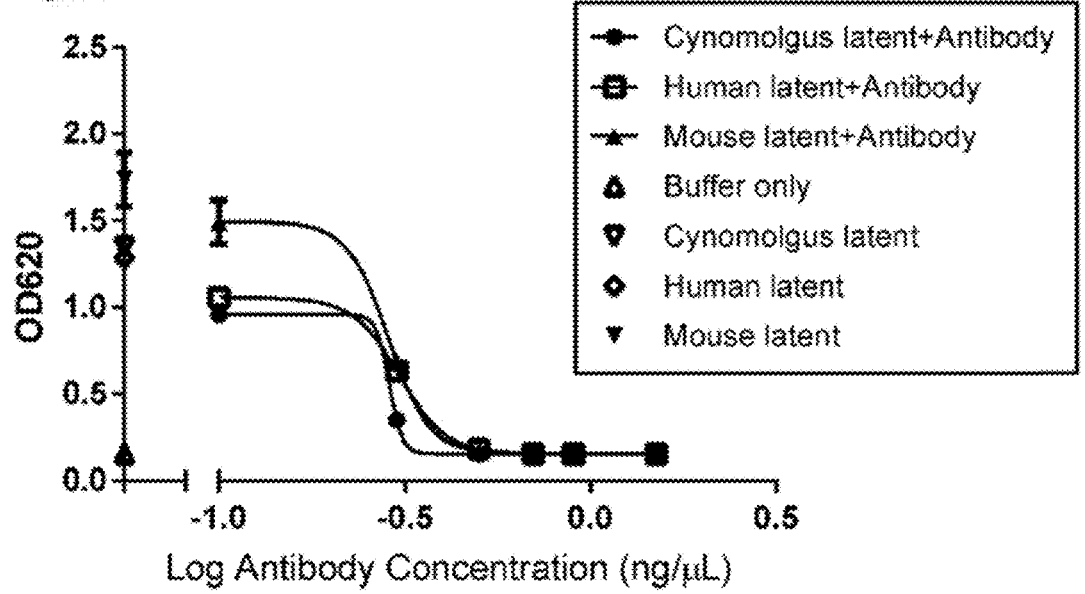
FIG. 2 illustrates inhibition of spontaneous activation of latent myostatin by anti-latent myostatin antibody, as described in Example 4. The activity of active myostatin released from latent myostatin by 37° C. incubation was measured in the presence of anti-latent myostatin antibody, using HEK Blue Assay.

Human, cynomolgus, or mouse latent myostatin was incubated with the anti-latent myostatin antibody at 37° C. overnight and the sample mixtures were transferred to HEK-Blue™ TGF-β cells. After 24-hour incubation, cell supernatant was mixed with QUANTIBlue™ and the optical density at 620 nm was measured in a colorimetric plate reader. As shown as FIG. 2, the liberation of active myostatin from its latent form was detected after incubation at 37° C. The presence of mAb MST1032-Glm, myostatin activation was inhibited and thus a lower SEAP level was detected in the cell supernatant. MST1032-G1 m inhibited spontaneous activation of latent myostatin, and showed almost comparable inhibition activity against human, cynomolgus, and mouse latent myostatin.

Example 5

Characterization of Anti-Latent Myostatin Antibody
(ELISA)

Figure 3:
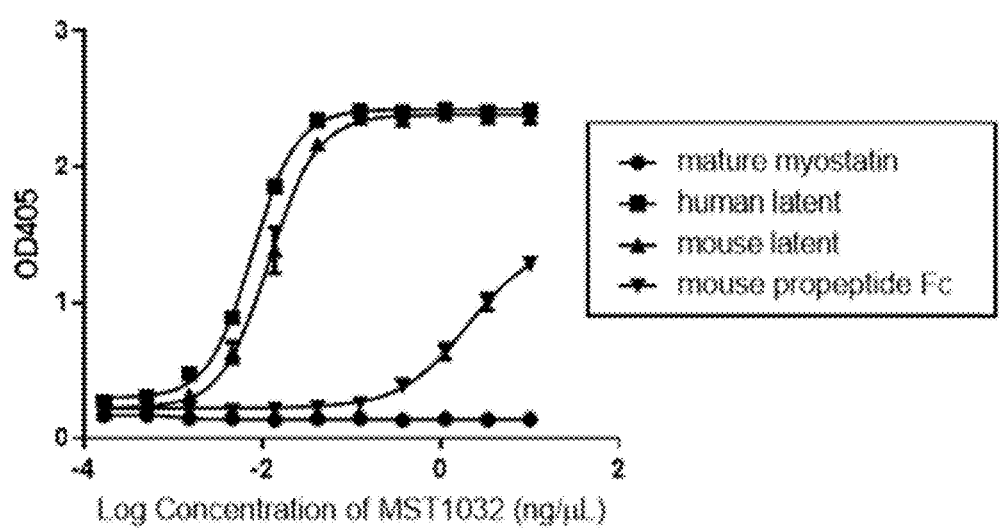
FIG. 3 illustrates binding of anti-latent myostatin antibody to propeptide domain, as described in Example 5.

Uncoated ELISA plates (NUNC-IMMUNO plate MAX-ISORP surface, Nalge Nunc International) were coated with 20 μL of 50 nM streptavidin (GenScript) for 1 hour at room temperature. Plates were then washed with PBST three times and blocked with 50 μL 20% Blocking One (Nacalai Tesque) overnight. On the next day, each well of each plate was incubated with biotinylated mature myostatin, human or mouse biotinylated latent myostatin, or biotinylated recombinant mouse myostatin propeptide-Fc chimera protein (R&D Systems) at 4 nM/well/20 μL for 2 hours. After washing, 20 L of antibody sample was added to the wells and the plates were left for 1 hour. The plates were washed and 20 L of anti-human IgG-horseradish peroxidase (HRP) (Abcam) diluted in HEPES-buffered saline was added, and the plates were left for another hour. The plates were then washed again, and then 50 μL ABTS (KPL) was added to each well, and the plates were incubated for 1 hour. The signal was detected at 405 nm in a colorimetric plate reader. The results of the binding experiment are shown in FIG. 3. MST1032-G1m bound to latent myostatin (i.e., the non-covalent complex of mature myostatin and propeptides) and propeptide, but did not bind to mature myostatin. These results show that MST1032-G1m specifically binds to the myostatin propeptide (e.g., the propeptide portion), but not to active myostatin (e.g., mature region).

Example 6

Characterization of Anti-Latent Myostatin Antibody
(Western Blot)

Mouse latent myostatin was incubated with recombinant human BMP1 (R&D Systems), with or without MST1032-G1m at 37° C. overnight. The samples were then mixed with 4× reducing SDS-PAGE sample buffer (Wako) and heated at 95° C. for 5 minutes and then loaded for SDS gel electrophoresis. Proteins were transferred to membrane by Trans-Blot® Turbo™ Transfer System (Bio-rad). Myostatin propeptide was detected using a sheep anti-mouse GDF8 propeptide antibody (R&D Systems), which was then detected by anti-sheep IgG-HRP (Santa Cruz). The membrane was incubated with ECL substrate, and imaged using an IMAGEQUANT™ LAS 4000 (GE Healthcare). As shown in FIG. 4, propeptide cleavage by BMP1 was inhibited by MST1032-G1m.

TABLE 2a

Anti-latent myostatin antibodies and their DNA and amino acid sequences (shown as SEQ ID NOs)

| | | Variable region | | | | Constant region | | | |
|---|---|---|---|---|---|---|---|---|---|
| | | Heavy | | Light | | Heavy | | Light | |
| Antibody name | Abbreviation | DNA | PROTEIN | DNA | PROTEIN | DNA | PROTEIN | DNA | PROTEIN |
| MS_MST1032Ha-G1m/MST1032La-k0MC | MST1032-G1m | 039 | 012 | 041 | 014 | 050 | 007 | 194 | 008 |
| MS_MST1032Ha-F760/MST1032La-k0MC | MST1032-F760 | 039 | 012 | 041 | 014 | 051 | 011 | 194 | 008 |
| MS_M103205H000-SG1/M103202L000-SK1 | MS1032LO00-SG1 or Ab001 | 040 | 013 | 042 | 015 | 052 | 009 | 054 | 010 |
| MS_M103205H000-F760/M103202L000-SK1 | MS1032LO00-F760 | 040 | 013 | 042 | 015 | 051 | 011 | 054 | 010 |
| MS_M103205H714-SG1/M103202L861-SK1 | MS1032LO01-SG1 | 043 | 032 | 046 | 035 | 052 | 009 | 054 | 010 |
| MS_M103205H781-SG1/M103202L719-SK1 | MS1032LO02-SG1 | 044 | 033 | 047 | 036 | 052 | 009 | 054 | 010 |
| MS_M103205H781-SG1/M103202L813-SK1 | MS1032LO03-SG1 | 044 | 033 | 048 | 037 | 052 | 009 | 054 | 010 |
| MS_M103205H707-SG1/M103202L802-SK1 | MS1032LO04-SG1 | 045 | 034 | 049 | 038 | 052 | 009 | 054 | 010 |
| MS_M103205H714-F760/M103202L861-SK1 | MS1032LO01-F760 | 043 | 032 | 046 | 035 | 051 | 011 | 054 | 010 |
| MS_M103205H781-F760/M103202L719-SK1 | MS1032LO02-F760 | 044 | 033 | 047 | 036 | 051 | 011 | 054 | 010 |
| MS_M103205H781-F760/M103202L813-SK1 | MS1032LO03-F760 | 044 | 033 | 048 | 037 | 051 | 011 | 054 | 010 |
| MS_M103205H707-F760/M103202L802-SK1 | MS1032LO04-F760 | 045 | 034 | 049 | 038 | 051 | 011 | 054 | 010 |

TABLE 2b

HVR amino acid sequences of anti-latent myostatin antibodies (shown as SEQ ID NOs)

| | | Hyper Variable region (HVR) | | | | | |
|---|---|---|---|---|---|---|---|
| Antibody name | Abbreviation | H1 | H2 | H3 | L1 | L2 | L3 |
| MS_MST1032Ha-G1m/MST1032La-k0MC | MST1032-G1m | 055 | 058 | 061 | 065 | 070 | 073 |
| MS_MST1032Ha-F760/MST1032La-k0MC | MST1032-F760 | 055 | 058 | 061 | 065 | 070 | 073 |
| MS_M103205H000-SG1/M103202L000-SK1 | MS1032LO00-SG1 or Ab001 | 055 | 058 | 061 | 065 | 070 | 073 |
| MS_M103205H000-F760/M103202L000-SK1 | MS1032LO00-F760 | 055 | 058 | 061 | 065 | 070 | 073 |
| MS_M103205H714-SG1/M103202L861-SK1 | MS1032LO01-SG1 | 057 | 058 | 063 | 067 | 071 | 074 |
| MS_M103205H781-SG1/M103202L719-SK1 | MS1032LO02-SG1 | 057 | 060 | 063 | 066 | 072 | 073 |
| MS_M103205H781-SG1/M103202L813-SK1 | MS1032LO03-SG1 | 057 | 060 | 063 | 068 | 070 | 074 |
| MS_M103205H707-SG1/M103202L802-SK1 | MS1032LO04-SG1 | 056 | 058 | 063 | 069 | 071 | 073 |
| MS_M103205H714-F760/M103202L861-SK1 | MS1032LO01-F760 | 057 | 058 | 063 | 067 | 071 | 074 |
| MS_M103205H781-F760/M103202L719-SK1 | MS1032LO02-F760 | 057 | 060 | 063 | 066 | 072 | 073 |
| MS_M103205H781-F760/M103202L813-SK1 | MS1032LO03-F760 | 057 | 060 | 063 | 068 | 070 | 074 |
| MS_M103205H707-F760/M103202L802-SK1 | MS1032LO04-F760 | 056 | 058 | 063 | 069 | 071 | 073 |

Example 7

Characterization of Anti-Latent Myostatin Antibody (BIACORE®)

The kinetic parameters of anti-latent myostatin antibodies against human, cynomolgus monkey (cyno), and mouse latent myostatin were assessed at 37° C. at pH7.4 using a BIACORE® T200 instrument (GE Healthcare). ProA/G (Pierce) was immobilized onto all flow cells of a CM4 chip using amine coupling kit (GE Healthcare). Anti-latent myostatin antibody and analytes were prepared in ACES pH7.4 (20 mM ACES, 150 mM NaCl, 1.2 mM $CaCl_2$, 0.05% TWEEN® 20, 0.005% $NaN_3$). Antibody was captured onto the sensor surface by ProA/G. Antibody capture levels were typically 150 to 220 resonance units (RU). Then human, cyno, or mouse latent myostatin was injected at 3.125 to 50 nM prepared by two-fold serial dilution, followed by dissociation. The sensor surface was regenerated with 25 mM NaOH. Kinetic parameters were determined by processing and fitting the data to a 1:1 binding model using BIACORE® T200 Evaluation software, version 2.0 (GE Healthcare). The sensorgrams are shown in FIG. 5. Association rate (ka), dissociation rate (kd), and binding affinity (KD) are listed in Table 3. The kinetic parameters of MST1032-G1m toward human, cyno, and mouse latent myostatin were comparable.

TABLE 3 ka, kd, and KD of anti-latent myostatin antibody MST1032-G1m

| | ka ($M^{-1}s^{-1}$) | kd ($s^{-1}$) | KD (M) |
|---|---|---|---|
| Human latent myostatin | 1.13E+06 | 8.65E−05 | 7.66E−11 |
| Mouse latent myostatin | 1.41E+06 | 8.16E−05 | 5.79E−11 |
| Cyno latent myostatin | 1.09E+06 | 7.79E−05 | 7.17E−11 |

Example 8

In Vivo Efficacy of Anti-Latent Myostatin Antibody on Muscle Mass and Fat Mass The in vivo efficacy of mAb MST1032-Glm was evaluated in mice. Anti-mature myostatin antibody 41C1E4 (as described in U.S. Pat. No. 7,632,499) was used as positive control in this study. To avoid potential immunomodulation due to a mouse anti-human antibody response, in vivo studies were performed in immune-deficient Severe Combined Immunodeficient (SCID) mice. Five-week-old SCID (C.B-17 SCID) mice (Charles River Laboratories Japan, Inc. (Kanagawa, JAPAN)) were treated with monoclonal antibodies at various doses or vehicle (PBS) given intravenously once per week for two weeks. On day 0, 7 and 14, full body lean mass and fat mass of the mice were assessed by nuclear magnetic resonance (NMR) (the minispec LF-50, Bruker Bio Spin, (Kanagawa, JAPAN)). The animals were euthanized on day 14, and the gastrocnemius and quadriceps muscles were dissected and weighed.

Statistical significance was determined by ANOVA, a Student's t-test and a Dunnett's test with JMP 9 software (SAS, Inc.). A p value of less than 0.05 was considered significant.

The results of this experiment are shown in FIGS. 6A-C. Both antibodies (MST1032-Glm and 41C1E4) increased lean body mass dose-dependently, and MST1032-Glm, when administered at 40 mg/kg, significantly decreased fat mass volume compared with the vehicle (PBS) group on day 14.

After two-week treatment, the antibodies administered at 10 mg/kg and 40 mg/kg resulted in significant increment of quadriceps and gastrocnemius wet weight relative to the vehicle group.

Example 9

Comparison of In Vivo Efficacy of Various Myostatin Related Antibodies

All experimental settings for the comparison were the same as in Example 8. Various myostatin related antibodies, 41C1E4, REGN, OGD, and MYO-029 were tested in five-week-old SCID mice for two weeks. REGN, OGD, and MYO-029 are anti-mature myostatin antibodies described in WO 2011/150008 as H4H1657N2, WO 2013/186719 as OGD 1.0.0., and WO 2004/037861 as MYO-029, respectively. These antibodies were administered intravenously once per week. Lean body mass and fat mass were examined by full-body NMR scanning on day 0 and 14. Grip strength was measured with a grip strength test meter (e.g., GPM-100B, MELQUEST Ltd., (Toyama, JAPAN)) on day 14. As shown in the results presented in FIGS. 7A-C, the lean body mass was increased by these antibodies except for MYO-029 ($P>0.05$). Grip strength of the MST1032-Glm-administered group was significantly increased relative to the vehicle (PBS) group, at 10 mg/kg ($P<0.05$). 41C1E4 and REGN also significantly increased grip strength compared with the vehicle (PBS). Full body fat mass tended to be reduced by 10 mg/kg of MST1032-Glm. Fat mass reduction efficacy of MST1032-Glm was stronger than that of other anti-mature myostatin antibodies.

Example 10

Humanization of Anti-Latent Myostatin Antibody

Amino acid residues of an antibody variable region are numbered according to Kabat (Kabat et al., Sequence of proteins of immunological interest, $5^{th}$ Ed., Public Health Service, National Institutes of Health, Bethesda, Md. (1991)).

Variable regions of the heavy and light chains for humanized MST1032 antibodies were designed. Some of the humanized MST1032 antibodies contain back mutation in framework region. The polynucleotides of the designed heavy and light chain variable regions were synthesised by GenScript Inc., and were cloned into expression vectors containing the heavy chain constant region SG1 sequence (SEQ ID NO: 52 (the amino acid sequence is shown in SEQ ID NO: 9)) and the light chain constant region SK1 sequence (SEQ ID NO: 54 (the amino acid sequence is shown in SEQ ID NO: 10)), respectively. Humanized antibodies were transiently expressed in FS293-F cells, and HEK Blue Assay and BIACORE® analysis were carried out as described above. As shown in FIG. 8 and Table 4, and compared to FIGS. 1 and 2, humanized antibody (MS1032LO00-SG1) showed comparable inhibition activity and affinity to chimeric antibody (MST1032-Glm).

TABLE 4

Kinetic parameters of humanized anti-latent myostatin antibody

| | ka (M$^{-1}$s$^{-1}$) | kd (s$^{-1}$) | KD (M) |
|---|---|---|---|
| MST1032-G1m | 1.13E+06 | 8.65E−05 | 7.66E−11 |
| MS1032LO00-SG1 | 1.27E+06 | 9.52E−05 | 7.50E−11 |

Example 11

Generation of pH-Dependent Anti-Latent Myostatin Antibody

To generate pH-dependent anti-latent myostatin antibodies, histidine scanning mutagenesis was conducted for all CDRs of mAb MS1032LO00-SG1. Each amino acid in the CDRs was individually mutated to histidine using In-Fusion HD Cloning Kit (Clontech Inc. or Takara Bio company) according to the manufacturer's instructions. After confirming through sequencing that each variant was mutated correctly, variants were transiently expressed and purified by the method described above. All histidine-substituted variants were evaluated by a modified BIACORE® assay as compared to that described above. Briefly, an additional dissociation phase at pH5.8 was integrated into the BIACORE® assay immediately after the dissociation phase at pH7.4. This is to assess the pH-dependent dissociation between antibody (Ab) and antigen (Ag) from the complexes formed at pH7.4 as opposed to the corresponding dissociation at pH5.8. The dissociation rate at pH5.8 buffer was determined by processing and fitting data using the Scrubber 2.0 (BioLogic Software) curve fitting software.

As shown in FIG. 9, the parental antibody (Ab001) showed no reduction in binding response at pH5.8 compared to the pH7.4 dissociation phase. Several of the single-histidine substitutions resulted in a moderate to strong reduction in binding response at pH5.8 compared to the pH7.4 dissociation phase. The dissociation rate at pH5.8 for each of the single-histidine substitution variants are shown in Table 5. As shown in Table 5, Ab002 showed the fastest Ab/Ag complex dissociation rate at pH5.8, more than 200 fold faster than parental antibody (Ab001). Antibodies with a combination of these mutations in the CDRs were then generated. The CDR sequences of the antibodies containing these various mutations are shown in Table 6.

Example 12

Affinity Improvement of pH-Dependent Anti-Latent Myostatin Antibody

To identify mutations which improve affinity at pH7.4 and/or in vitro inhibition activity, more than 500 variants were generated for heavy and light chain respectively, using at least one variant generated in Example 11 as a template. These variants had each amino acid in the CDRs substituted with 18 other amino acids, excluding the original amino acid and Cysteine. The binding ability of variants to human latent myostatin was assessed at 37° C. under pH7.4 using BIACORE® 4000 instrument (GE Healthcare). Culture supernatant containing variants in FS293-F cells was prepared with ACES pH7.4 buffer containing 10 mg/ml BSA and 0.1 mg/ml carboxymethyl dextran (CMD). Each antibody was captured onto the flow cells until the capture level reached around 200 RU. Then 25 nM human latent myostatin was injected over the flow cells. An additional dissociation phase at pH5.8 was integrated into the BIACORE® assay immediately after

TABLE 5 pH 5.8 dissociation rate for single histidine substituted anti-latent myostatin antibodies

| Name of variable region | | | |
|---|---|---|---|
| Heavy chain | Light chain | Abbreviation | kd (1/s) |
| M103205H000 | M103202L000 | Ab001 | 2.92E−05 |
| M103205H001 | M103202L000 | Ab002 | 6.09E−03 |
| M103205H009 | M103202L000 | Ab003 | 8.80E−04 |
| M103205H026 | M103202L000 | Ab004 | 1.86E−04 |
| M103205H028 | M103202L000 | Ab005 | 7.63E−05 |
| M103205H000 | M103202L008 | Ab006 | 6.58E−05 |
| M103205H028 | M103202L008 | Ab007 | 4.15E−04 |

TABLE 6

CDR sequences and their SEQ ID NOs of histidine substituted anti-latent myostatin antibodies Heavy Chain

| Antibody name | Variable region | Hyper Variable region (HVR) | | | Kabat No. | | | | | | | | | | | |
|---|---|---|---|---|---|---|---|---|---|---|---|---|---|---|---|---|
| | | H1 | H2 | H3 | 31 | 32 | 33 | 34 | 35 | 50 | 51 | 52 | 53 | 54 | 55 | 56 | 57 | 58 |
| M103205H000 | 015 | 055 | 058 | 061 | S | Y | O | I | S | I | I | S | Y | A | G | S | T | Y |
| M103205H001 | 016 | 056 | 058 | 061 | H | Y | O | I | S | I | I | S | Y | A | G | S | T | V |
| M103205H009 | 017 | 055 | 059 | 061 | S | Y | O | I | S | I | I | S | H | A | G | S | T | Y |
| M103205H006 | 018 | 055 | 058 | 062 | S | Y | O | I | S | I | I | S | Y | A | G | S | T | Y |
| M103205H008 | 019 | 055 | 058 | 063 | S | Y | O | I | S | I | I | S | Y | A | G | S | T | Y |
| M103205H033 | 020 | 056 | 059 | 061 | H | Y | O | I | S | I | I | S | H | A | G | S | T | V |
| M103205H034 | 021 | 059 | 059 | 062 | S | Y | O | I | S | I | I | S | H | A | G | S | T | Y |
| M103205H035 | 022 | 058 | 058 | 062 | H | Y | O | I | S | I | I | S | Y | A | G | S | T | Y |
| M103205H036 | 023 | 056 | 059 | 062 | H | Y | O | I | S | I | I | S | H | A | G | S | T | V |
| M103205H707 | 024 | 055 | 058 | 063 | H | Y | O | I | S | I | I | S | Y | A | G | S | T | Y |
| M103205H708 | 025 | 055 | 059 | 063 | S | Y | O | I | S | I | I | S | H | A | G | S | T | Y |
| M103205H709 | 026 | 055 | 058 | 064 | S | Y | O | I | S | I | I | S | Y | A | G | S | T | V |
| M103205H710 | 027 | 066 | 059 | 063 | H | Y | O | I | S | I | I | S | H | A | G | S | T | Y |
| M103205H711 | 028 | 065 | 059 | 064 | S | Y | O | I | S | I | I | S | H | A | G | S | T | Y |
| M103205H712 | 029 | 066 | 058 | 064 | H | Y | O | I | S | I | I | S | Y | A | G | S | T | Y |
| M103205H713 | 030 | 056 | 056 | 064 | H | Y | O | I | S | I | I | S | H | A | G | S | T | Y |

TABLE 6-continued

CDR sequences and their SEQ ID NOs of histidine substituted anti-latent myostatin antibodies Heavy Chain

| Antibody name | \multicolumn{16}{c}{Kabat No.} | | | | | | | | | | | | | | | |
|---|---|---|---|---|---|---|---|---|---|---|---|---|---|---|---|---|
| | 59 | 60 | 61 | 62 | 63 | 64 | 65 | 95 | 96 | 97 | 98 | 99 | 100 | 100a | 100b | 100c | 101 | 102 |
| M103205H000 | Y | A | S | W | A | K | G | G | V | P | A | Y | S | T | G | G | O | L |
| M103205H001 | Y | A | S | W | A | K | G | G | V | P | A | Y | S | T | G | G | O | L |
| M103205H009 | Y | A | S | W | A | K | G | G | V | P | A | Y | S | T | G | G | O | L |
| M103205H006 | Y | A | S | W | A | K | G | G | V | P | A | H | S | T | G | G | O | L |
| M103205H008 | Y | A | S | W | A | K | G | G | V | P | A | Y | S | H | G | G | O | L |
| M103205H033 | Y | A | S | W | A | K | G | G | V | P | A | Y | S | T | G | G | O | L |
| M103205H034 | Y | A | S | W | A | K | G | G | V | P | A | H | S | T | G | G | O | L |
| M103205H035 | Y | A | S | W | A | K | G | G | V | P | A | H | S | T | G | G | O | L |
| M103205H036 | Y | A | S | W | A | K | G | G | V | P | A | H | S | T | G | G | O | L |
| M103205H707 | Y | A | S | W | A | K | G | G | V | P | A | Y | S | H | G | G | O | L |
| M103205H708 | Y | A | S | W | A | K | G | G | V | P | A | Y | S | H | G | G | O | L |
| M103205H709 | Y | A | S | W | A | K | G | G | V | P | A | H | S | H | G | G | O | L |
| M103205H710 | Y | A | S | W | A | K | G | G | V | P | A | Y | S | H | G | G | O | L |
| M103205H711 | Y | A | S | W | A | K | G | G | V | P | A | H | S | H | G | G | O | L |
| M103205H712 | Y | A | S | W | A | K | G | G | V | P | A | H | S | H | G | G | O | L |
| M103205H713 | Y | A | S | W | A | K | G | G | V | P | A | H | S | H | G | G | O | L |

Light Chain

| Antibody name | Variable region | Hyper Variable region (HVR) | | | Kabat No. | | | | | | | | | | |
|---|---|---|---|---|---|---|---|---|---|---|---|---|---|---|---|
| | | L1 | L2 | L3 | 24 | 25 | 26 | 27 | 27a | 27b | 28 | 29 | 30 | 31 | 32 | 33 |
| M103202L003 | 015 | 065 | 070 | 075 | Q | S | S | Q | S | V | Y | O | N | N | W | L |
| M103202L008 | 091 | 066 | 070 | 073 | Q | S | S | Q | S | V | V | H | N | N | W | L |

Light Chain

| Antibody name | \multicolumn{17}{c}{Kabat No.} | | | | | | | | | | | | | | | | |
|---|---|---|---|---|---|---|---|---|---|---|---|---|---|---|---|---|---|
| | 34 | 50 | 51 | 52 | 53 | 54 | 55 | 56 | 89 | 90 | 91 | 92 | 93 | 94 | 95 | 95a | 96 | 97 |
| M103202L003 | S | W | A | S | T | L | A | S | A | G | G | Y | G | G | G | L | V | A |
| M103202L008 | S | W | A | S | T | L | A | S | A | G | G | Y | G | G | G | L | Y | A | the dissociation phase at pH7.4. This additional dissociation phase assesses the pH-dependent dissociation between antibody (Ab) and antigen (Ag) from the complexes formed at pH7.4. The flow cell surface was regenerated with 25 mM NaOH. Kinetic parameters were determined using BIACORE® 4000 Evaluation software, version 2.0 (GE Healthcare). Analysis of additional dissociation at pH5.8 was performed using Scrubber2 (BioLogic Software).

Variants with improved affinity at pH7.4 and/or in vitro inhibition activity were selected, and combined with mutations improving pH dependency identified in Example 11. After combination of these mutations, four variants (MS1032L001, 02, 03, and 04) were selected, and transiently expressed in SG1 or F760 (SEQ ID NO: 11 and 51) for BIACORE® binding kinetic analysis, in vitro and/or in vivo assays. Both SG1 and F760 are human heavy chain constant regions. The binding affinities of SG1 against human FcγRs are comparable to that for the natural IgG constant region, but that of F760 is abolished by Fc modification (also described herein as silent Fc). Amino acid and nucleotide sequences of the four anti-myostatin variants are shown in Table 2a.

Example 13

Characterization of pH-Dependent MS1032 Variants (HEK Blue Assay (BMP1 and Spontaneous Activation))

All experimental settings were the same as in Examples 3 and 4. As shown in FIG. 10, all variants showed comparable inhibition activity against human latent myostatin to MS1032LO00-SG1.

Example 14

Characterization of pH-Dependent MS1032 Variants (BIACORE®)

All experimental settings were the same as in Example 7, except that measurements were also performed in ACES pH5.8 buffer in addition to ACES pH7.4 condition. Some antibodies were only measured against human latent myostatin. Antibody capture level was aimed at 185 RU and 18.5 RU, for avidity and affinity assay, respectively. Kinetic parameters were determined using 1:1 Binding fitting using BIACORE® T200 Evaluation software, version 2.0 (GE Healthcare). The sensorgrams of all antibodies against human latent myostatin with avidity condition are shown in FIG. 11, and ka, kd, and KB calculated from different conditions are listed in Tables 7-10. Under the avidity condition, all antibodies except MS1032LO0-SG1 showed a faster dissociation rate under acidic pH than neutral pH. Under the affinity condition, all antibodies except MS132LO00-SG1 showed a weak interaction with latent myostatin under acidic pH and therefore, kinetic parameters were not determined.

TABLE 7 ka, kd, and KD of avidity condition assay under neutral pH

| | Human latent myostatin | | | Mouse latent myostatin | | | Cyno latent myoststin | | |
|---|---|---|---|---|---|---|---|---|---|
| | ka ($M^{-1}s^{-1}$) | kd ($s^{-1}$) | KD (M) | ka ($M^{-1}s^{-1}$) | kd ($s^{-1}$) | KD (M) | ka ($M^{-1}s^{-1}$) | kd ($s^{-1}$) | KD (M) |
| MS1032LO00-SG1 | 1.27E+06 | 9.52E−05 | 7.50E−11 | 1.52E+06 | 7.18E−05 | 4.71E−11 | 1.21E−06 | 8.08E−05 | 6.66E−11 |
| MS1032LO01-SG1 | 1.27E+06 | 2.16E−04 | 1.70E−10 | 1.45E+06 | 2.17E−04 | 1.49E−10 | 1.19E+06 | 1.97E−04 | 1.65E−10 |
| MS1032LO02-SG1 | 8.36E+05 | 2.49E−04 | 2.98E−10 | N/T | N/T | N/T | N/T | N/T | N/T |
| MS1032LO03-SG1 | 9.81E+05 | 1.92E−04 | 1.96E−10 | N/T | N/T | N/T | N/T | N/T | N/T |
| MS1032LO04-SG1 | 1.33E+06 | 2.17E−04 | 1.63E−10 | N/T | N/T | N/T | N/T | N/T | N/T |

N/T: not tested

TABLE 8 ka, kd, and KD of avidity condition assay under acidic pH

| | Human latent myostatin | | | Mouse latent myostatin | | | Cyno latent myostatin | | |
|---|---|---|---|---|---|---|---|---|---|
| | ka ($M^{-1}s^{-1}$) | kd ($s^{-1}$) | KD (M) | ka ($M^{-1}s^{-1}$) | kd ($s^{-1}$) | KD (M) | ka ($M^{-1}s^{-1}$) | kd ($s^{-1}$) | KD (M) |
| MS1032LO00-SG1 | 1.60E+06 | 1.28E−04 | 7.97E−11 | 2.32E+06 | 2.02E−05 | 8.70E−12 | 1.79E+06 | 1.58E−05 | 8.83E−12 |
| MS1032LO01-SG1 | 1.22E+06 | 2.42E−02 | 1.99E−08 | 1.02E+06 | 6.25E−03 | 6.15E−09 | 7.64E+05 | 6.80E−03 | 8.90E−09 |
| MS1032LO02-SG1 | 1.70E+06 | 4.14E−02 | 2.43E−08 | N/T | N/T | N/T | N/T | N/T | N/T |
| MS1032LO03-SG1 | 5.43E+05 | 5.24E−03 | 9.66E−09 | N/T | N/T | N/T | N/T | N/T | N/T |
| MS1032LO04-SG1 | 7.81E+05 | 7.13E−03 | 9.13E−09 | N/T | N/T | N/T | N/T | N/T | N/T |

N/T: not tested

TABLE 9 ka, kd, and KD of affinity condition assay under nentral pH

| | Human latent myostatin | | | Mouse latent myostatin | | | Cyno latent myostatin | | |
|---|---|---|---|---|---|---|---|---|---|
| | ka ($M^{-1}s^{-1}$) | kd ($s^{-1}$) | KD (M) | ka ($M^{-1}s^{-1}$) | kd ($s^{-1}$) | KD (M) | ka ($M^{-1}s^{-1}$) | kd ($s^{-1}$) | KD (M) |
| MS1032LO00-SG1 | 1.07E+06 | 2.45E−04 | 2.30E−10 | 1.31E+06 | 1.60E−04 | 1.22E−10 | 1.02E+06 | 2.13E−04 | 2.09E−10 |
| MS1032LO01-SG1 | 1.64E+36 | 1.29E−03 | 7.88E−10 | 1.50E+06 | 1.07E−03 | 7.13E−10 | 1.15E+06 | 1.10E−03 | 9.54E−10 |
| MS1032LO02-SG1 | 1.09E+06 | 1.79E−03 | 1.64E−09 | N/T | N/T | N/T | N/T | N/T | N/T |
| MS1032LO03-SG1 | 1.08E+06 | 1.17E−03 | 1.08E−09 | N/T | N/T | N/T | N/T | N/T | N/T |
| MS1032LO04-SG1 | 1.54E+06 | 1.25E−03 | 8.12E−10 | N/T | N/T | N/T | N/T | N/T | N/T |

N/T: not tested

TABLE 10 ka, kd, and KD affinity condition assay under acidic pH

| | Human latent myostatin | | | Mouse latent myostatin | | | Cyno latent myostatin | | |
|---|---|---|---|---|---|---|---|---|---|
| | ka ($M^{-1}s^{-1}$) | kd ($s^{-1}$) | KD (M) | ka ($M^{-1}s^{-1}$) | kd ($s^{-1}$) | KD (M) | ka ($M^{-1}s^{-1}$) | kd ($s^{-1}$) | KD (M) |
| MS1032LO00-SG1 | 1.09E+06 | 2.35E−04 | 2.15E−10 | 1.62E+06 | 7.08E−05 | 4.38E−11 | 1.41E+06 | 1.96E−04 | 1.39E−10 |
| MS1032LO01-SG1 | n.d. | n.d. | n.d. | n.d. | n.d. | n.d. | n.d. | n.d. | n.d. |
| MS1032LO02-SG1 | n.d. | n.d. | n.d. | N/T | N/T | N/T | N/T | N/T | N/T |
| MS1032LO03-SG1 | n.d. | n.d. | n.d. | N/T | N/T | N/T | N/T | N/T | N/T |
| MS1032LO04-SG1 | n.d. | n.d. | n.d. | N/T | N/T | N/T | N/T | N/T | N/T | n.d.: not determined,
N/T: not tested

Example 15

Comparison of Plasma Total Myostatin Concentration Between Antibodies with FcγR Binding and an Abolished FcγR Binding in Mice In Vivo Test Using C.B-17 SCID Mice The accumulation of endogenous myostatin was assessed in vivo upon administration of anti-latent myostatin antibody in C.B-17 SCID mice (In Vivos, Singapore). An anti-latent myostatin antibody (3 mg/ml) was administered at a single dose of 10 ml/kg into the caudal vein. Blood was collected 5 minutes, 7 hours, 1 day, 2 days, 3 days, 7 days, 14 days, 21 days, and 28 days after administration. The collected blood was centrifuged immediately at 14,000 rpm in 4'C for 10 minutes to separate the plasma. The separated plasma was stored at or below −80° C. until measurement. The anti-latent myostatin antibodies used were MS1032LO00-SG1 and MS1032LO00-F760.

Measurement of Total Myostatin Concentration in Plasma by Electrochemiluminescence (ECL)

The concentration of total myostatin in mouse plasma was measured by ECL. Anti-mature myostatin-immobilized plates were prepared by dispensing anti-mature myostatin antibody RK35 (as described in WO 2009/058346) onto a MULTI-ARRAY 96-well plate (Meso Scale Discovery) and incubated overnight at 4° C. Mature myostatin calibration curve samples and mouse plasma samples diluted 40-fold or more were prepared. The samples were mixed in an acidic solution (0.2 M Glycine-HCl, pH2.5) to dissociate mature myostatin from its binding protein (such as propeptide). Subsequently, the samples were added onto an anti-mature myostatin-immobilized plate, and allowed to bind for 1 hour at room temperature before washing. Next, SULFO TAG labelled anti-mature myostatin antibody RK22 (as described in WO 2009/058346) was added and the plate was incubated for 1 hour at room temperature before washing. Read Buffer T (×4) (Meso Scale Discovery) was immediately added to the plate and signal was detected by SECTOR Imager 2400 (Meso Scale Discovery). The mature myostatin concentration was calculated based on the response of the calibration curve using the analytical software SOFTMAX® PRO (Molecular Devices). The time course of total myostatin concentration in plasma after intravenous administration of anti-latent myostatin antibody measured by this method is shown in FIG. 12.

Effect of FcγR Binding on Myostatin Accumulation In Vivo

Alter administration of antibody MS1032LO00-F760, the plasma total myostatin concentration at day 28 accumulated 248 fold compared to plasma total myostatin concentration at 5 minutes. In contrast, after administration of MS1032LO00-SG1, plasma total myostatin concentration at day 28 accumulated 37 fold compared to plasma total myostatin concentration at 5 minutes. An approximately 7 fold difference of plasma total myostatin concentration at day 28 was observed between MS1032LO00-F760 (silent Fc) and MS1032LO0-SG1 due to FcγR binding. In human soluble IL-6R (hsIL-6R), no significant difference in plasma hsIL-6R concentration was observed between anti-hsIL-6R antibody-F760 (silent Fc) and -SG1 as described in WO 2013/125667. Since hsIL-6R is a monomeric antigen, antibody-hsIL-6R complex contains only 1 Fc. Therefore, the result in WO 2013/125667 suggested that an antibody-antigen complex with 1 Fc has no significant binding to FcγR in vivo to accelerate the uptake of immune complex by cells. On the other hand, a multimeric antigen (such as myostatin), antibody can make a large immune complex and the antibody-antigen complex contains more than 2 Fc. Therefore, a significant difference in plasma antigen concentration can be observed between F760 and SG1 due to strong avidity binding against FcγR. The result suggests that MST1032 can form a large immune complex which contains more than 2 antibodies with myostatin.

Example 16

Comparison of Plasma Total Myostatin Concentration Between Non-pH Dependent Anti-Latent Myostatin Antibody and pH-Dependent Anti-Latent Myostatin Antibody in Mice In Vivo Test Using C.B-17 SCID Mice The in vivo accumulation of endogenous mouse myostatin was assessed after administering anti-latent myostatin antibody in C.B-17 SCID mice (In Vivos, Singapore) as described in Example 15. The anti-latent myostatin antibodies used were MS1032LO01 I-SG1 and MS1032LO01-F760.

Measurement of Total Myostatin Concentration in Plasma by ECL

The concentration of total myostatin in mouse plasma was measured by ECL as described in Example 15. The time course of plasma total myostatin concentration after intravenous administration of anti-latent myostatin antibody as measured by this method is shown in FIG. 13.

Effect of pH-Dependent Myostatin Binding on Myostatin Accumulation In Vivo

The pH-dependent anti-latent myostatin antibodies (MS1032LO01-SG1 and MS1032LO01-F760) were tested in vivo and comparison of plasma total myostatin concentration was made. The total myostatin concentration measurement results after administration of MS1032LO00-SG1 and MS1032LO00-F760 described in Example 15 are also shown in FIG. 13. MS1032LO00 is non pH-dependent antibody and MS1032LO01 is pH-dependent antibody. As shown in FIG. 13, total myostatin concentration after administration of MS1032LO01-F760 was reduced compared to MS1032LO00-F760 due to pH-dependent binding. Moreover, total myostatin concentration after administration of MS1032LO01-SG1 was dramatically reduced compared to that of MS1032LO00-SG1 due to pH-dependent binding and increased cellular uptake by FcγR binding. It is expected that MS1032LO01-SG1 has a superior property of enhancing myostatin clearance from plasma as a "sweeping antibody".

Example 17

In Vivo Efficacy of pH-Dependent Anti-Latent Myostatin Antibody

All experimental settings were the same as in Example 8. As shown in FIG. 14, when administrated intravenously to SCID mice at doses of 0.2, 1, and 5 mg/kg, MS1032LO00-SG1 (non-sweeping antibody) and MS1032LO0 I-SG1 (sweeping antibody) increased skeletal muscle mass dose-dependently after 2 weeks. MS1032LO01-SG1 significantly increased quadriceps wet weight and grip strength at 1 and 5 mg/kg, and increased lean body mass and gastrocnemius wet weight at 5 mg/kg relative to the vehicle group (PBS). MS1032LO01-SG1 also significantly decreased fat mass at 1 and 5 mg/kg relative to the vehicle group (PBS). MS1032LO00-SG1 showed no increase in lean body mass at 0.2 mg/kg. On the other hand, MS1032LO01-SG1 drastically increased lean body mass, quadriceps wet weight, gastrocnemius wet weight and grip strength at 0.2 mg/kg. Hence, a pH-dependent binding antibody shows greater muscle mass growth and muscle power improvement relative to a non pH-dependent binding antibody.

Example 18

Expression and Purification of Human and Mouse Latent GDF11

Human GDF11 with Flag-tag on N-terminus (also described herein as Flag-hGDF11, human latent GDF11, hGDF11, or human GDF11, SEQ ID NO: 85) were expressed transiently using FREESTYLE™ 293-F cells (Thermo Fisher). Conditioned media expressing Flag-hGDF11 was applied to a column packed with anti-Flag M2 affinity resin (Sigma) and eluted with Flag peptide (Sigma).

Fractions containing Flag-hGDF11 were collected and subsequently subjected to a SUPERDEX® 200 gel filtration column (GE healthcare) equilibrated with 1x PBS. Fractions containing the Flag-hGDF11 were then pooled and stored at −80° C.

Example 19

Characterization of Anti-Latent Myostatin Antibody (ELISA)

Uncoated ELISA plates (NUNC-IMMUNO plate MAX-ISORP™ surface, Nalge Nunc International) were coated with 20 μL of 50 nM streptavidin (GenScript) for 2 hour at room temperature. Plates were then washed with PBST three times and blocked with 50 μL 20% Blocking One (Nacalai Tesque) for overnight. On the next day, each well of the plates was incubated with biotinylated human latent myostatin at 2 nM/well/20 μL or biotinylated human latent GDF11 at 20 nM/well/20 μL for 2 hours. After washing, 20 μL of antibody sample was added to the wells and the plates were left for 1 hour. The plates were washed and 20 μL of anti-human IgG-horseradish peroxidase (HRP) (Abcam) diluted in HEPES-buffered saline was added, and the plates were left for another hour. The wells were washed again, and then 50 μL ABTS (KPL) was added to each well, and the plates were incubated for 1 hour. The signal was detected at 405 nm in a colorimetric plate reader. The results of the binding experiment are shown in FIG. 15. MST1032-G1m bound to latent myostatin (i.e., non-covalent complex of mature myostatin and propeptides), but didn't bind to hGDF11. These results show that MST1032-G1m specifically binds to myostatin, not to hGDF11.

Example 20

Characterization of Anti-Latent Myostatin Antibody (HEK Blue Assay (BMP1 and Spontaneous Activation))

A reporter gene assay was used to assess the biological activity of active GDF11 in vitro. HEK-Blue™ TGF-β cells (Invivogen) that express a Smad3/4-binding element (SBE)-inducible SEAP reporter gene, allow the detection of bioactive GDF11 by monitoring the activation of the activin type 1 and type 2 receptors. Active GDF11 stimulates the production and secretion of SEAP into the cell supernatant. The quantity of SEAP secreted is then assessed using QUANTIBlue™ (Invivogen).

HEK-Blue™ TGF-β cells were maintained in DMEM medium (Gibco) supplemented with 10% fetal bovine serum, 50 μg/mL streptomycin, 50 U/mL penicillin, 100 μg/mL Normocin™, 30 μg/mL of Blasticidin, 2001 μg/mL of HygroGold™ and 100 μg/mL of Zeocin™. During the functional assay, cells were changed to assay medium (DMEM with 0.1% bovine serum albumin, streptomycin, penicillin and Normocin™) and seeded to a 96-well plate. Human GDF11 was incubated with or without recombinant human BMP1 (Calbiochem) and anti-latent antibody (MST1032-G1m) at 37° C. overnight. The sample mixtures were transferred to cells. After 24-hour incubation, the cell supernatant was mixed with QUANTIBlue™ and the optical density at 620 nm was measured in a colorimetric plate reader. As shown as FIG. 16, MST1032-G1m did not prevent protease-mediated or spontaneous activation of human GDF11 and thus failed to inhibit the secretion of SEAP.

Example 21

Further Optimization of MS1032 Variants to Enhance the Sweeping Effect

As the pH dependent antibody, MS1032LO01-SG1, showed superior efficacy in mouse, further optimization was conducted to increase pH dependency, to enhance up-take into cells, to increase stability, and so on by introducing mutations into the antibody CDRs or by changing framework regions. More than a thousand variants were assessed in a BIACORE® and/or HEK Blue Assay as described above, and MS1032LO06-SG1, MS1032LO07-SG1, MS1032LO10-SG1, MS1032LO11-SG1, MS1032LO12-SG1, MS1032LO18-SG1, MS1032LO19-SG1, MS1032LO21-SG1, MS1032LO23-SG1, MS1032LO24-SG1, MS1032LO25-SG1, and MS1032LO26-SG1 were generated. Their amino acid and nucleotide sequences of these generate antibodies are shown in Table 11.

The affinity of MS1032 variant binding to human, cynomolgus monkey (cyno), or mouse latent myostatin at pH7.4 and pH5.8 was determined at 37° C. using BIACORE® T200 instrument (GE Healthcare) to assess the effect of pH on antigen binding. ProA/G (Pierce) was immobilized onto all flow cells of a CM4 chip using an amine coupling kit (GE Healthcare). All antibodies and analytes were prepared in ACES pH7.4 or pH5.8 buffer containing 20 mM ACES, 150 mM NaCl, 1.2 mM CaCl2, 0.05% TWEEN® 20, 0.005% NaN$_3$. Each antibody was captured onto the sensor surface by proA/G. Antibody capture levels were typically 130 to 240 resonance units (RU). Human, cyno, and mouse latent myostatin was injected at 3.125 to 50 nM prepared by two-fold serial dilution, followed by dissociation. The sensor surface was regenerated each cycle with 10 mM Glycine HCl pH1.5. Binding affinity was determined by processing and fitting the data to a 1:1 binding model using BIACORE® T200 Evaluation software, version 2.0 (GE Healthcare).

The affinity (KD) of MS1032 variants binding to human, cynomolgus monkey (cyno), and mouse latent myostatin at pH7.4 and pH5.8 are shown in Table 12. All variants showed a KD ratio ((KD at pH5.8)/(KD at pH7.4)) of over 5, indicating pH dependent binding to latent myostatin Example 22

Evaluation of the Neutralization Activity of Further Optimized Variants in HEK Blue Assay We evaluated the neutralization activity of MS1032LO06-SG1, MS1032LO07-SG1, MS1032LO10-SG1, MS1032LO11-SG1, MS1032LO12-SG1, MS1032LO18-SG1, MS1032LO19-SG1, MS1032LO21-SG1, MS1032LO23-SG1 and MS1032LO25-SG1 against human latent myostatin as described in Example 3. As shown in FIG. 17, all variants showed comparable activity to MS1032LO01-SG1.

Example 23

Comparison of Plasma Total Myostatin Concentration Between Non-pH Dependent Anti-Latent Myostatin Antibody and Different pH-Dependent Anti-Latent Myostatin Antibodies in Mice In Vivo Test Using C.B-17 SCID Mice The accumulation of endogenous myostatin was assessed in vivo upon administration of anti-latent myostatin antibody in C.B-17 SCID mice (In Vivos, TABLE 11a MS1032 variants and their DNA and amino acid sequences (shown as SEQ ID NOs)

| | | Variable region | | | | Constant region | | | |
| --- | --- | --- | --- | --- | --- | --- | --- | --- | --- |
| | | Heavy | | Light | | Heavy | | Light | |
| Antibody name | Abbreviation | DNA | PROTEIN | DNA | PROTEIN | DNA | PROTEIN | DNA | PROTEIN |
| MS_M103205H795-SG1/M103202L889-SK1 | MS1032LO06-SG1 | 100 | 86 | 110 | 96 | 052 | 009 | 054 | 010 |
| MS_M103205H1004-SG1/M103202L889-SK1 | MS1032LO07-SG1 | 101 | 87 | 110 | 96 | 052 | 009 | 054 | 010 |
| MS_M103205H1046-SG1/M103202L889-SK1 | Ms1032LO10-SG1 | 102 | 88 | 110 | 96 | 052 | 009 | 054 | 010 |
| MS_M103205H1047-SG1/M103202L889-SK1 | MS1032LO11-SG1 | 103 | 89 | 110 | 96 | 052 | 009 | 054 | 010 |
| MS_M103205H1057-SG1/M103202L889-SK1 | MS1032LO12-SG1 | 104 | 90 | 110 | 95 | 052 | 009 | 054 | 010 |
| MS_M103205H1186-SG1/M103202L889-SK1 | MS1032LO18-SG1 | 105 | 91 | 110 | 96 | 052 | 009 | 054 | 010 |
| MS_M103240H795-SG1/M103202L1045-SK1 | MS1032LO19-SG1 | 106 | 92 | 111 | 97 | 052 | 009 | 054 | 010 |
| MS_M103245H795-SG1/M103202L1045-SK1 | MS1032LO21-SG1 | 107 | 93 | 111 | 97 | 052 | 009 | 054 | 010 |
| MS_M103245H1233-SG1/M103202L1045-SK1 | MS1032LO23-SG1 | 108 | 94 | 111 | 97 | 052 | 009 | 054 | 010 |
| MS_M103205H795-SG1/M103202L1060-SK1 | MS1032LO24-SG1 | 100 | 86 | 112 | 98 | 052 | 009 | 054 | 010 |
| MS_M103240H1246-SG1/M103202L1045-SK1 | MS1032LO25-SG1 | 109 | 95 | 111 | 97 | 052 | 009 | 054 | 010 |
| MS_M103240H795-SG1/M103209L1045-SK1 | MS1032LO26-SG1 | 106 | 92 | 113 | 99 | 052 | 009 | 054 | 010 |

TABLE 11b

HVR amino acid sequences of MS1032 variants (shown as SEQ ID NOs)

| | | Hyper Variable region (HVR) | | | | | |
| --- | --- | --- | --- | --- | --- | --- | --- |
| Antibody name | Abbreviation | H1 | H2 | H3 | L1 | L2 | L3 |
| MS_M103205H795-SG1/M103202L889-SK1 | MS1032LO06-SG1 | 114 | 58 | 63 | 122 | 71 | 74 |
| MS_M103205H1004-SG1/M103202L889-SK1 | MS1032LO07-SG1 | 114 | 116 | 121 | 122 | 71 | 74 |
| MS_M103205H1046-SG1/M103202L889-SK1 | MS1032LO10-SG1 | 57 | 117 | 63 | 122 | 71 | 74 |
| MS_M103205H1047-SG1/M103202L889-SK1 | MS1032LO11-SG1 | 57 | 118 | 63 | 122 | 71 | 74 |
| MS_M103205H1057-SG1/M103202L889-SK1 | MS1032LO12-SG1 | 57 | 119 | 63 | 122 | 71 | 74 |
| MS_M103205H1186-SG1/M103202L889-SK1 | MS1032LO18-SG1 | 114 | 118 | 63 | 122 | 71 | 74 |
| MS_M103240H795-SG1/M103202L1045-SK1 | MS1032LO19-SG1 | 114 | 58 | 63 | 123 | 71 | 74 |
| MS_M103245H795-SG1/M103202L1045-SK1 | MS1032LO21-SG1 | 114 | 58 | 63 | 123 | 71 | 74 |
| MS_M103245H1233-SG1/M103202L1045-SK1 | MS1032LO23-SG1 | 115 | 58 | 63 | 123 | 71 | 74 |
| MS_M103205H795-SG1/M103202L1060-SK1 | MS1032LO24-SG1 | 114 | 58 | 63 | 124 | 125 | 74 |
| MS_M103240H1246-SG1/M103202L1045-SK1 | MS1032LO25-SG1 | 115 | 120 | 63 | 123 | 71 | 74 |
| MS_M103240H795-SG1/M103209L1045-SK1 | MS1032LO26-SG1 | 114 | 58 | 63 | 123 | 71 | 74 |

TABLE 12

Kinetic parameters of MS1032 variants

| | | | Human latent myostatin | | |
| --- | --- | --- | --- | --- | --- |
| | Name of variable region | | KD pH | KD pH | ratio of KD at pH |
| Ab name | Heavy chain | Light chain | 7.4 (M) | 5.8 (M) | 5.8/pH 7.4 |
| MS1032LO06-5G1 | M103205H795 | M103202L889 | 2.85E−10 | 3.40E−08 | 119 |
| MS1032LO07-SG1 | M103205H1004 | M103202L889 | 2.75E−10 | 4.62E−08 | 168 |
| MS1032LO10-SG1 | M103205H1046 | M103202L889 | 3.51E−10 | 4.38E−08 | 125 |
| MS1032LO11-SG1 | M103205H1047 | M103202L889 | 4.19E−10 | 1.43E−07 | 341 |
| MS1032LO12-SG1 | M103205H1057 | M103202L889 | 4.07E−10 | 8.49E−08 | 209 |
| MS1032LO18-SG1 | M103205H1186 | M103202L889 | 3.29E−10 | n.d. | n.d. |
| MS1032LO19-SG1 | M103240H795 | M103202L1045 | 2.73E−10 | 4.58E−08 | 168 |
| MS1032LO21-SG1 | M103245H795 | M103202L1045 | 2.57E−10 | 5.23E−08 | 204 |
| MS1032LO23-SG1 | M103245H1233 | M103202L1045 | 2.60E−10 | 1.61E−08 | 62 |
| MS1032LO24-SG1 | M103205H795 | M103202L1060 | 1.64E−10 | 1.52E−09 | 9 |
| MS1032LO25-SG1 | M103240H1246 | M103202L1045 | 2.76E−10 | 2.55E−08 | 92 |

| | Cyno latent myostatin | | | Mouse latent myostatin | | |
| --- | --- | --- | --- | --- | --- | --- |
| | KD pH | KD pH | ratio of KD at pH | KD pH | KD pH | ratio of KD at pH |
| Ab name | 7.4 (M) | 5.8 (M) | 5.8/pH 7.4 | 7.4 (M) | 5.8 (M) | 5.8/pH 7.4 |
| MS1032LO06-5G1 | 3.43E−10 | 2.59E−08 | 76 | 2.99E−10 | 2.26E−08 | 76 |
| MS1032LO07-SG1 | 3.39E−10 | 3.47E−08 | 102 | 3.19E−10 | 3.08E−08 | 97 |
| MS1032LO10-SG1 | 4.19E−10 | 1.61E−08 | 38 | 3.14E−10 | 1.09E−08 | 35 |
| MS1032LO11-SG1 | 5.02E−10 | 4.35E−08 | 87 | 3.62E−10 | 2.92E−08 | 81 |

TABLE 12-continued

Kinetic parameters of MS1032 variants

| | | | | | | |
|---|---|---|---|---|---|---|
| MS1032LO12-SG1 | 4.92E−10 | 3.58E−08 | 73 | 4.13E−10 | 2.48E−08 | 60 |
| MS1032LO18-SG1 | 3.54E−10 | 8.09E−08 | 229 | 2.72E−10 | n.d. | n.d |
| MS1032LO19-SG1 | 3.26E−10 | 3.56E−08 | 109 | 2.71E−10 | 2.87E−08 | 106 |
| MS1032LO21-SG1 | 3.09E−10 | 3.10E−08 | 100 | 2.61E−10 | 2.94E−08 | 113 |
| MS1032LO23-SG1 | 2.99E−10 | 7.71E−09 | 26 | 2.66E−10 | 6.40E−09 | 24 |
| MS1032LO24-SG1 | 1.89E−10 | 9.29E−10 | 5 | 1.76E−10 | 1.02E−09 | 6 |
| MS1032LO25-SG1 | 3.40E−10 | 1.41E−08 | 41 | 2.59E−10 | 9.88E−09 | 38 | n.d.: not determined

Singapore). An anti-latent myostatin antibody (3 mg/ml) was administered at a single dose of 10 ml/kg into the caudal vein. Blood was collected 5 minutes, 7 hours, 1 day, 2 days, 3 days, 7 days, 14 days, 21 days, and 28 days after administration. The collected blood was centrifuged immediately at 14,000 rpm in 4° C. for 10 minutes to separate the plasma. The separated plasma was stored at or below −80° C. until measurement. The anti-latent myostatin antibodies tested were MS1032LO00-SG1, MS1032LO01-SG1, MS1032LO06-SG1, MS1032LO11-SG1, MS1032LO18-SG1, MS1032LO19-SG1, MS1032LO21-SG1 and MS1032LO25-SG1.

The accumulation of endogenous myostatin was assessed in vivo upon administration of anti-latent myostatin antibody in C.B-17 SCID mice (In Vivos, Singapore). An anti-latent myostatin antibody (3 mg/ml) was administered at a single dose of 10 ml/kg into the caudal vein. Blood was collected 5 minutes, 7 hours, 1 day, 2 days, 3 days, 7 days, 14 days, 21 days, and 28 days after administration. The collected blood was centrifuged immediately at 14,000 rpm in 4° C. for 10 minutes to separate the plasma. The separated plasma was stored at or below −80° C. until measurement. The anti-latent myostatin antibodies tested were MS1032LO00-SG1, MS1032LO01-SG1, MS1032LO06-SG1, MS1032LO11-SG1, MS1032LO18-SG1, MS1032LO9-SG1, MS1032LO21-SG1 and MS1032LO25-SG1.

Measurement of Total Myostatin Concentration in Plasma by Electrochemiluminescence (ECL)

The concentration of total myostatin in mouse plasma was measured by ECL. Anti-mature myostatin-immobilized plates were prepared by dispensing biotinylated anti-mature myostatin antibody RK35 (as described in WO 2009/058346) onto a MULTI-ARRAY 96-well streptavidin plate (Meso Scale Discovery) and incubated in blocking buffer for 2 hours at room temperature. Mature myostatin calibration curve samples and mouse plasma samples diluted 40-fold or more were prepared. The samples were mixed in an acidic solution (0.2 M Glycine-HCl, pH2.5) to dissociate mature myostatin from its binding protein (such as propeptide). Subsequently, the samples were added onto an anti-mature myostatin-immobilized plate, and allowed to bind for 1 hour at room temperature before washing. Next, SULFO TAG labelled anti-mature myostatin antibody RK22 (as described in WO 2009/058346) was added and the plate was incubated for 1 hour at room temperature before washing. Read Buffer T (×4) (Meso Scale Discovery) was immediately added to the plate and signal was detected by SECTOR Imager 2400 (Meso Scale Discovery). The mature myostatin concentration was calculated based on the response of the calibration curve using the analytical software SOFTMAX® PRO (Molecular Devices). The time course of total myostatin concentration in plasma after intravenous administration of anti-latent myostatin antibody measured by this method is shown in FIG. 18.

Effect of pH-Dependent Myostatin Binding on Myostatin Accumulation in Mice In Vivo Study The effect of pH-dependency on myostatin accumulation in mice was compared using non pH-dependent anti-latent myostatin antibody (MS1032LO00-SG1) and different pH-dependent anti-latent myostatin antibodies (MS1032LO01-SG1, MS1032LO06-SG1, MS1032LO11-SG1, MS1032LO18-SG1, MS1032LO19-SG1, MS1032LO21-SG1 and MS1032LO25-SG1). Introduction of pH-dependency significantly accelerates myostatin clearance from SCID mouse plasma. As shown in FIG. 18, pH-dependent anti-latent myostatin antibodies (MS1032LO01-SG1, MS1032LO06-SG1, MS1032LO11-SG1, MS1032LO18-SG1, MS1032LO19-SG1, MS1032LO21-SG1 and MS1032LO25-SG1) could reduce myostatin accumulation compared to non pH-dependent anti-latent myostatin antibody (MS1032LO00-SG1) at day 28.

Example 24

Comparison of Plasma Total Myostatin Concentration Between Non-pH Dependent Anti-Latent Myostatin Antibody and Anti-Latent Myostatin Antibodies with Both pH- and Fc Engineering in Cynomologous Monkey In Vivo Test Using Cynomolgus Monkey The accumulation of endogenous myostatin was assessed in vivo upon administration of anti-latent myostatin antibody in 2-4 year old *Macaca fascicularis* (cynomolgus monkey) from Cambodia (Shin Nippon Biomedical Laboratories Ltd., Japan). An anti-latent myostatin antibody was administered at a dose level of 30 mg/kg into the cephalic vein of the forearm using a disposable syringe, extension tube, indwelling needle, and infusion pump. The dosing speed was 30 minutes per body. Blood was collected before the start of dosing and either 5 minutes, 7 hours and 1, 2, 3, 7, 14, 21, 28, 35, 42, 49 and 56 days after the end of dosing, or 5 minutes and 2, 4, and 7 hours and 1, 2, 3, 7, 14, 21, 28, 35, 42, 49 and 56 days after the end of dosing. Blood was drawn from the femoral vein with a syringe containing heparin sodium. The blood was immediately cooled on ice, and plasma was obtained by centrifugation at 4° C., 1700×g for 10 minutes. The plasma samples were stored in a deep freezer (acceptable range: −70° C. or below) until measurement. The anti-latent myostatin antibodies used were MS1032LO00-SG1, MS1032LO06-SG1012, MS1032LO06-SG1016, MS1032LO06-SG1029, MS1032LO06-SG1031, MS1032LO06-SG1033, and MS1032LO06-SG1034 (herein, SG1012, SG1016, SG1029, SG1031, SG1033, and SG1034 are the heavy chain constant regions constructed based on SG1 as described below).

A dose level of 2 mg/kg was administered into the cephalic vein of the forearm or saphenous vein using a disposable syringe, and indwelling needle for the anti-latent myostatin antibodies MS1032LO19-SG1079, MS1032LO19-SG1071, MS1032LO19-SG1080, MS1032LO19-SG1074, MS1032LO19-SG1081, and MS1032LO19-SG1077 (herein, SG1079, SG1071, SG1080, SG1074, SG1081, and SG1077 are the heavy chain constant regions constructed based on SG1 as described below). Blood was collected before the start of dosing and 5 minutes and 2, 4, and 7 hours and 1, 2, 3, 7, 14 days after the end of dosing. The blood was processed as described above. Plasma samples were stored in a deep freezer (acceptable range: −70° C. or below) until measurement.

Measurement of Total Myostatin Concentration in Plasma by Electrochemiluminescence (ECL)

The concentration of total myostatin in monkey plasma was measured by ECL as described in Example 23. The time course of plasma total myostatin concentration after intravenous administration of anti-latent myostatin antibody as measured by this method is shown in FIG. 19.

Measurement of ADA in Monkey Plasma Using Electrochemiluminescence (ECL)

Biotinylated drug was coated onto a MULTI-ARRAY 96-well streptavidin plate (Meso Scale Discovery) and incubated in low cross buffer (Candor) for 2 hours at room temperature. Monkey plasma samples were diluted 20 fold in low cross buffer before addition to the plate. Samples were incubated overnight at 4° C. On the next day, the plate was washed thrice with wash buffer before addition of SULFO TAG labelled anti monkey IgG secondary antibody (Thermo Fisher Scientific). After incubating for an hour at room temperature, the plate was washed three times with wash buffer. Read Buffer T (×4) (Meso Scale Discovery) was immediately added to the plate and signal was detected using a SECTOR Imager 2400 (Meso Scale Discovery).

Effect of pH-Dependent and Fc Engineering on Myostatin Accumulation in Monkey In Vivo In cynomolgus monkey, the administration of a non pH-dependent anti-latent myostatin antibody (MS1032LO00-SG1) resulted in an at least 60 fold increase in myostatin concentration from baseline at day 28. At day 28, the administration of pH-dependent anti-latent myostatin antibodies MS1032LO06-SG1012 and MS1032LO06-SG1033 resulted in an 3 fold and 8 fold increase in myostatin concentration from baseline, respectively. The strong sweeping of myostatin was mainly contributed by the increase in affinity to cynomolgus monkey FcγRIIb. At day 28, pH-dependent anti-latent myostatin antibodies MS1032LO06-SG1029, MS1032LO06-SG1031 and MS1032LO06-SG1034 could sweep myostatin to below baseline. The reasons for strong myostatin sweeping of MS1032LO06-SG1029, MS1032LO06-SG1031 and MS1032LO06-SG1034 are an increase in non-specific uptake in the cell due to increase in positive charge cluster of the antibody and/or an increase in FcγR-mediated cellular uptake due to enhanced binding to FcγR.

The administration of the pH-dependent anti-latent myostatin antibodies, MS1032LO19-SG1079, MS1032LO19-SG1071, MS1032LO19-SG1080, MS1032LO19-SG1074, MS1032LO19-SG1081 and MS1032LO19-SG1077, reduced myostatin concentration to below the detection limit (<0.25 ng/mL) from day 1 in cynomolgus monkey. On day 14, the concentration of myostatin increased above the detectable limit for MS1032LO19-SG1079 and MS1032LO19-SG1071 while the concentration of myostatin remained below the detectable limit for MS1032LO19-SG1080, MS1032LO19-SG1074, MS1032LO19-SG1081 and MS1032LO19-SG1077. The weaker suppression of myostatin concentration levels by the MS1032LO19-SG1079 and MS1032LO19-SG1071 antibodies could be due to the differences in pI mutations that are contained in these antibodies.

The data suggests that strong sweeping of myostatin from the plasma was achieved by mutations in the anti-myostatin antibodies that increase binding to FcγRIIb or that increase the positive charge of the antibody and increase binding to FcγRIIb. It is expected that strong sweeping of myostatin could be achieved in human by combining mutations that increase positive charge of the antibody and increase binding to FcγR.

Example 25

In Vivo Efficacy of Further Optimized Variants in Mouse

As described in Example 8, the in vivo efficacy was evaluated in Scid mouse using MS1032LO06-SG1, MS1032LO11-SG1, MS1032LO18-SG1, MS1032LO19-SG1, and MS1032LO25-SG1. Three independent studies were conducted and MS1032LO01 was used as the control.

The results of these experiments are shown in FIGS. 20A-20I. All antibodies (MS1032LO06-SG1, MS1032LO11-SG1, MS1032LO18-SG1, MS1032LO19-SG1, and MS1032LO25-SG1) showed a dose-dependent increase in lean body mass (LBM) as well as appendicular grip strength. The antibodies also showed a decrease in the body fat mass dose-dependently.

Example 26

Epitope Mapping of Anti-Latent Myostatin Antibodies

Additional anti-human latent myostatin antibodies were generated for mapping of their corresponding binding epitopes. Two NZW rabbits were immunized and harvested as described in Example 2. 1760 antibody producing B-cell lines identified were further screened for their ability to block BMP1 mediated activation of human latent myostatin. Briefly, B-cell supernatant containing secreted antibodies were incubated with human latent myostatin in the presence of recombinant human BMP1 (R&D Systems) at 37° C. overnight. 50 μL of the reaction mix were then transferred to Meso Scale Discovery MULTI-ARRAY 96-well plate coated with anti-mature myostain antibody RK35 (as described in WO 2009/058346). After 1 hour incubation at room temperature with shaking, the plates were incubated with biotinylated anti-mature myostatin antibody RK22 (as described in WO 2009/058346) followed by SULFO-tagged streptavidin. Read Buffer T (×4) (Meso Scale Discovery) was then added to the plate and ECL signal was detected by SECTOR Imager 2400 (Meso Scale Discovery). 94 lines showing different levels of neutralizing activities were selected for downstream analysis (MST1495-MST1588). The variable regions of these selected lines were cloned as described in Example 2, except an expression vector with the heavy chain constant region F1332m sequence (SEQ ID NO: 193) was used.

The inhibitory activity on human latent myostatin activation was further evaluated for a panel of 7 anti-latent myostatin antibodies (MST1032, MST1504, MST11538, MST1551, MST1558, MST1572, and MST1573; the sequence identifiers for amino acid sequences of these antibodies are shown in Table 13). As shown in FIG. 21, all of the antibodies were able to inhibit the BMP1 mediated activation of human latent myostatin in a dose-dependent manner.

TABLE 13

Amino acid sequences of anti-latent myostatin antibodies

| | SEQ ID NO: | | | | | | |
|---|---|---|---|---|---|---|---|
| Antibody | VH | VL | HVR-H1 | HVR-H2 | HVR-H3 | HVR-L1 | HVR-L2 | HVR-L3 |
| MST1032 | 12 | 14 | 55 | 58 | 61 | 65 | 70 | 73 |
| MST1504 | 145 | 151 | 157 | 163 | 169 | 175 | 181 | 187 |
| MST1538 | 146 | 152 | 158 | 164 | 170 | 176 | 182 | 188 |
| MST1551 | 147 | 153 | 159 | 165 | 171 | 177 | 183 | 189 |
| MST1558 | 148 | 154 | 160 | 166 | 172 | 178 | 184 | 190 |
| MST1572 | 149 | 155 | 161 | 167 | 173 | 179 | 185 | 191 |
| MST1573 | 150 | 156 | 162 | 168 | 174 | 180 | 186 | 192 |

4 antibodies that worked well in Western blotting were selected for epitope mapping. Fragments of the N-terminal propeptide coding region of human latent myostatin were cloned into a pGEX4.1 vector so as to produce GST tagged propeptide fragments of 100 amino acid each, with 80 amino acid overlap (FIG. 22A). Protein expression was induced in transformed BL21 competent cells with Overnight Express Autoinduction System (Merck Millipore) and protein was extracted using the BUGBUSTER® protein extraction reagent (Novagen). Expression of the desired protein fragments at about 37 kDa were verified by Western blotting analysis as described in Example 6 (anti-GST antibody (Abcam)) (FIG. 22B). When tested with anti-human latent myostatin antibodies, as shown in FIG. 22C, although all 4 antibodies could inhibit latent myostatin activation, they recognized different epitopes on human latent myostatin. MST1032 antibody could detect the first five fragments, no bands were detected after the removal of amino acid 81-100 (SEQ ID NO:78). Both MST1538 and MST1572 antibodies bind to the first three fragments only, no bands were detected in the absence of amino acid 41-60 of SEQ ID NO:78. Antibody MST1573 only bound strongly to the first two fragments, suggesting that its epitope lies within amino acid 21-40 of SEQ ID NO:78 (FIG. 22D).

Example 27

Development of Novel FcγRIIb-Enhanced Fc Variants

In this example, Fc engineering to enhance myostatin clearance is illustrated.

It has been demonstrated in WO 2013/125667 that clearance of a soluble antigen can be enhanced by its administration of antigen-binding molecules comprising an Fc domain displaying an increased affinity for FcγRIIb. Furthermore, Fc variants that can show enhanced binding to human FcγRIIb have been illustrated in WO 2012/115241 and WO 2014/030728. It has been also illustrated that these Fc variants can show selectively enhanced binding to human FcγRIIb and decreased binding to other active FcγRs. This selective enhancement of FcγRIIb binding can be favorable not only for clearance of soluble antigen but also for decreasing the risk of undesired effector functions and immune response.

For development of an antibody drug, the efficacy, pharmacokinetics, and safety are typically evaluated in non-human animals in which the drug is pharmacologically active. If the antibody is only active in humans, the alternative approaches such as the use of a surrogate antibody must be considered (Bussiere et al., Int. J. Tox. 28: 230-253 (2009)). However, it is not easy to predict the effects of the interaction between the Fc region of the antibody and FcγRs in humans using a surrogate antibody because the expression patterns, protein sequences and/or functions of FcγRs in non-human animals are not always the same as in humans. It is therefore preferable that the Fc regions of antibody drugs have cross-reactivity to FcγRs in non-human animals, such as cynomolgous monkey, which have similar FcγR expression patterns and functions to FcγRs in humans, so that the results obtained in the non-human animals can be extrapolated to humans.

Therefore Fc variants that display cross-reactivity to human and cynoFcγRs were developed in this study.

Affinity Measurement of an Existing FcγRIIb-Enhanced Fc Variant Against Human and Monkey FcγRs The heavy chain gene of the human FcγRIIb enhanced variant (herein, "FcγRIIb enhanced" means "with enhanced FcγRIIb-binding activity") disclosed in WO 2012/115241 was generated by substituting Pro at position 238 in EU numbering with Asp in the heavy chain of MS1032LO06-SG1 which is named M103205H795-SG1 (VH, SEQ ID NO: 86; CH, SEQ ID NO: 9). The resultant heavy chain is referred to as M103205H795-MY009 (VH, SEQ ID NO: 86; CH, SEQ ID NO: 252). As the antibody light chain, M103202L889-SK1 (VL, SEQ ID NO: 96; CL, SEQ ID NO: 10) was used. The recombinant antibody was expressed according to the method shown in Example 34.

The extracellular domains of FcγRs were prepared in the following manner. The synthesis of the genes for the extracellular domain of human FcγRs were carried out in methods known to those skilled in the art based on the information registered in the NCBI. Specifically, FcγRIIa was based on the sequence of NCBI accession # NM_001136219.1, FcγRIIb was on NM_004001.3, FcγRIIIa was on NM_001127593.1, respectively. Allotypes of FcγRIIa and FcγRIIIa were prepared according to the reports about polymorphism for FcγRIIa (J. Exp. Med. 172:19-25 (1990)) and for FcγRIIIa (J. Clin. Invest. 100(5):1059-1070 (1997)), respectively. The synthesis of the gene for the extracellular domain of cynomolgus monkey FcγRs were constructed by cloning cDNA of each FcγRs from cynomolgus monkeys using the methods known to those skilled in the art. The amino acid sequences of the constructed extracellular domains of FcγRs were shown in the sequence list: (SEQ ID NO 210 for human FcγRIIaR, SEQ ID NO 211 for human FcγRIIaH, SEQ ID NO 214 for human FcγRIIb, SEQ ID NO 217 for human FcγRIIIaF, SEQ ID NO 218 for human FcγRIIIaV, SEQ ID NO 220 for cyno FcγRIIa1, SEQ ID NO 221 for cyno FcγRIIa2, SEQ ID NO 222 for cyno FcγRIIa3, SEQ ID NO 223 for cyno FcγRIIb, SEQ ID NO 224 for cyno FcγRIIIaS). Then His-tag was added to their C-terminus and the obtained each gene was inserted into expression vector designed for mammalian cell expression. The expression vector was introduced into the human embryonic kidney cell-derived FREESTYLE™ 293 cells (Invitrogen) to express the target protein. After culturing, the resulting culture supernatant was filtered and purified by the following four steps in principle. The cation exchange chromatography using SP Sepharose FF was performed as the first step, an affinity chromatography against the His-tag (HisTrap HP) as the second step, a gel filtration column chromatography (SUPERDEX® 200) as the third step, and sterile filtration as the fourth step. The absorbance at 280 nm of the purified proteins were measured using a spectrophotometer and the concentration of the purified protein was determined using an extinction coefficient calculated by the method of PACE (*Protein Science* 4:2411-2423 (1995)).

The kinetic analysis of interactions between these antibodies and FcγR was carried out using BIACORE® T200 or BIACORE® 4000 (GE Healthcare). HBS-EP+ (GE Healthcare) was used as the running buffer, and the measurement temperature was set to 25° C. A chip produced by immobilizing Protein A, Protein A/G or mouse anti-human IgG kappa light chain (BD Biosciences) onto a Series S Sensor Chip CM4 or CM5 (GE Healthcare) by the amine-coupling method was used. An antibody of interest was captured onto this chip to interact with each FcγR that had been diluted with the running buffer, and binding to the antibody was measured. After the measurement, the antibody captured on the chip was washed off by allowing reaction with 10 mM glycine-HCl, pH1.5 and 25 mM NaOH so that the chip was regenerated and used repeatedly. The sensorgrams obtained as measurement results were analyzed by the 1:1 Langmuir binding model using the BIACORE® Evaluation Software to calculate the binding rate constant ka (L/mol·s) and dissociation rate constant kd (l/s), and the dissociation constant KD (mol/L) was calculated from these values. Since the binding of MS1032LO06-MY009 to human FcγRIIaH, human FcγRIIIaV, and cynoFcγRIIIaS was weak, kinetic parameters such as KD could not be calculated from the above-mentioned analytical method. Regarding such interactions, KD values were calculated using the following 1:1 binding model described in BIACORE® T100 Software Handbook BR1006-48 Edition AE.

The behavior of interacting molecules according to the 1:1 binding model on BIACORE® can be described by Equation 1: Req=C·R max/(KD+C)+RI, wherein, Req is a plot of steady-state binding levels to analyte concentration, C is concentration, RI is bulk refractive index contribution in the sample, and Rmax is analyte binding capacity of the surface. When this equation is rearranged, KD can be expressed as Equation 2: KD=C·Rmax/(Req−RI)−C. KD can be calculated by substituting the values of Rmax, RI, and C into Equation 1 or Equation 2. From the current measurement conditions, RI=0, C=2 μmol/L can be used. Furthermore, the Rmax value obtained when globally fitting the sensorgram obtained as a result of analyzing the interaction of each FcγR with IgG1 using the 1:1 Langmuir binding model was divided by the amount of SG1 captured, this was multiplied by the amount of MY009 captured, and the resulting value was used as Rmax. This calculation is based on the hypothesis that the limit quantity of each FcγR that can be bound by SG1 remains unchanged for all variants produced by introducing mutations into SG1, and the Rmax at the time of measurement is proportional to the amount of antibody bound on the chip at the time of measurement. Req was defined as the amount of binding of each FcγR to each variant on the sensor chip observed at the time of measurement.

Table 14 shows the result of kinetic analysis of SG1 and MY009 against human and cynoFcγRs. The KD values in cells filled in gray were calculated using [Equation 2]since their affinity was too weak to be correctly determined by kinetic analysis. Values of KD fold were calculated by dividing the KD value of SG1 by the KD value of the variant for each FcγR.

As shown in Table 14, human FcγRIIb-enhanced variant MY009 does not show enhanced binding to cynoFcγRIIb but shows enhanced binding to human FcγRIIb. Its affinity to cynoFcγRIIb was rather decreased by 0.4-fold compared to SG1, indicating that human FcγRIIb-enhanced variant MY009 does not have cross-reactivity to cynoFcγRs.
Development of Novel Fc Variant that Shows Enhanced Binding to Both Human and cynoFcγRIIb Ideally, novel Fc variant should have enhanced binding to both human and cynoFcγRIIb selectively and a decreased binding to other active FcγRs. However, because the putative Fc binding residues in cynoFcγRIIb are completely the same as either allotype of cynoFcγRIIa (FIG. 23), it is theoretically impossible to achieve selective enhancement of cynoFcγRIIb binding over cynoFcγRIIa. Therefore a novel Fc variant should have selectively enhanced binding to human FcγRIIb, cynoFcγRIIb and cynoFcγRIIa.

TABLE 14

| Cross reactivity of a human FcγRIIb-enhanced variant to cynoFcγRs | | | | | | | | | |
|---|---|---|---|---|---|---|---|---|---|
| Heavy chain name | Substitution | KD (M) for cynoFcgRs | | | | | KD (M) for humanFcgRs | | | |
| | | FcgRIIa2 | FcgRIIa2 | FcgRIIa3 | FcgRIIb | FcgRIIIaS | FcgRIIaH | FcgRIIaR | FcgRIIb | FcgRIIIaV |
| M103205H795-SG1 | — | 4.2E−06 | 5.2E−05 | 1.5E−05 | 1.7E−06 | 4.2E−07 | 9.3E−07 | 1.4E−05 | 4.7E−06 | 1.2E−06 |
| M103205H795-MY013 | P238D | 2.5E−05 | 2.0E−06 | 3.1E−05 | 4.3E−06 | 1.0E−04 | 3.5E−06 | 2.0E−06 | 1.4E−06 | 5.5E−04 |

| Heavy chain name | KD fold for cynoFcgRs (SG1 = 1) | | | | | KD fold for humanFcgRs (SG1 = 1) | | | |
|---|---|---|---|---|---|---|---|---|---|
| | FcgRIIa1 | FcgRIIa2 | FcgRIIa3 | FcgRIIb | FcgRIIIaS | FcgRIIaH | FcgRIIaR | FcgRIIb | FcgRIIIaV |
| M103205H795-SG1 | 1.0 | 1.0 | 1.0 | 1.0 | 1.000 | 1.00 | 1.0 | 1.0 | 1.000 |
| M103205H795-MY013 | 0.2 | 0.2 | 0.5 | 0.4 | 0.004 | 0.01 | 0.1 | 3.3 | 0.002 |

In order to obtain a novel Fc variant that shows selectively enhanced binding to both human and cyno FcγRIIb, the results of comprehensive mutagenesis study performed in WO 2012/115241 were used. In the comprehensive mutagenesis study, comprehensive mutations were introduced into all the positions in FcγR binding regions in IgG1 antibodies and binding to each FcγR was analyzed comprehensively as shown in the following procedures.

The variable region of a glypican 3 antibody comprising the CDR of GpH7 which is an anti-glypican 3 antibody with improved plasma kinetics disclosed in WO 2009/041062 was used as the antibody heavy chain variable region (GpH7: SEQ ID NO: 225). Similarly, for the antibody light chain, GpL16-k0 (SEQ ID NO: 226) of the glypican 3 antibody with improved plasma kinetics disclosed in WO 2009/041062 was used. Furthermore, B3 (SEQ ID NO: 228) in which a K439E mutation has been introduced into G Id (SEQ ID NO: 227) produced by removing the C terminal Gly and Lys of IgG1 was used as the antibody H chain constant region. This heavy chain, which has been made by fusing GpH7 and B3, is referred to as GpH7-B3 (VH, SEQ ID NO: 225; CH, SEQ ID NO: 228).

With respect to GpH7-B3, the amino acid residues that are considered to be involved in FcγR binding and the surrounding amino acid residues (positions 234 to 239, 265 to 271, 295, 296, 298, 300, and 324 to 337, according to EU numbering) were substituted, respectively, with 18 amino acid residues excluding the original amino acid residue and Cys. These Fc variants are referred to as B3 variants. B3 variants were expressed and the binding of protein-A purified antibodies to each FcγR (FcγRIIa type H, FcγRIIa type R, FcγRIIb, and FcγRIIIaF) was comprehensively evaluated as follows. Analysis of interaction between each altered antibody and the Fcγ receptor prepared as mentioned above was carried out using BIACORE® T100 (GE Healthcare), BIACORE® T200 (GE Healthcare), BIACORE® A100, or BIACORE® 4000. HBS-EP+ (GE Healthcare) was used as the running buffer, and the measurement temperature was set to 25° C. Chips produced by immobilizing Protein A (Thermo Scientific), Protein A/G (Thermo Scientific), or Protein L (ACTIGEN or BioVision) by the amine coupling method to a Series S sensor Chip CM5 or CM4 (GE Healthcare) were used. After capturing of antibodies of interest onto these sensor chips, an Fcγ receptor diluted with the running buffer was allowed to interact, the amount bound to an antibody was measured. However, since the amount of Fcy receptor bound depends on the amount of the captured antibodies, the amount of Fcy receptor bound was divided by the amount of each antibody captured to obtain corrected values, and these values were compared. Furthermore, antibodies captured onto the chips were washed by 10 mM glycine-HCl, pH1.5, and the chips were regenerated and used repeatedly. The value of the amount of FcγR binding of each B3 variant was divided by the value of the amount of FcγR binding of the parental B3 antibody (an antibody having the sequence of a naturally-occurring human IgG1 at positions 234 to 239, 265 to 271, 295, 296, 298, 300, and 324 to 337, according to EU numbering). The value obtained by multiplying this value by 100 was used as an indicator of the relative FcγR-binding activity of each variant.

Table 15 shows the binding profile of promising substitutions selected based on the following criteria (more than 40% to human FcγRIIb, lower than 100% to human FcγRIIaR and FcγRIIaH, less than 10% to human FcγRIIIaF, compared to those of parental B3 antibody).

TABLE 15

Binding profile of selected substitutions against human FcγRs

| | Binding to human FcgRs (parent B3 = 100) | | | |
|---|---|---|---|---|
| Mutation | FcgRIIaH | FcgRIIaR | FcgRIIb | FcgRIIIaV |
| G236N | 54 | 81 | 75 | 8 |
| G237Y | 77 | 4 | 85 | 0 |
| G237D | 74 | 0 | 95 | 0 |
| P238E | 21 | 2 | 97 | 1 |
| P238Y | 93 | 9 | 114 | 3 |
| P238M | 86 | 9 | 97 | 2 |
| P238Q | 19 | 4 | 43 | −1 |
| S239P | 49 | 4 | 61 | −1 |
| V266F | 91 | 8 | 88 | 2 |
| S267H | 27 | 3 | 42 | 1 |
| S267L | 63 | 3 | 112 | 2 |
| N325L | 93 | 13 | 116 | 0 |
| N325E | 49 | 13 | 40 | 4 |
| N325I | 76 | 8 | 97 | 1 |
| N325F | 65 | 6 | 72 | −1 |
| A327I | 37 | 12 | 46 | 8 |

In the next step, cross-reactivity of these substitutions to cynoFcγRs was evaluated. These 16 mutations were introduced into M103205H795-SG1. The variants were expressed using M103202L889-SK as light chain and their affinity to cynoFcγRIIa1, IIa2, IIa3, IIb, IIIaS were analyzed.

Table 16 shows the binding profile of these 16 variants to cynoFcγRs. The value of the amount of FcγR binding was obtained by dividing the amount of FcγR bound by the amount of each antibody captured. This value was further normalized using the value for SG1 as 100.

TABLE 16

Binding profile of selected substitutions to cynoFcγRs

| | | Binding to cynoFcgRs (SG1 = 100) | | | | |
|---|---|---|---|---|---|---|
| CH Name | Substitution | FcgRIIa1 | FcgRIIa2 | FcgRIIa3 | FcgRIIb | FcgRIIIaS |
| SG1 | | 100 | 100 | 100 | 100 | 100 |
| MY001 | G236N | 83 | 86 | 62 | 85 | 15 |
| SG165 | G237Y | 18 | 17 | 30 | 30 | 7 |
| SG166 | G237D | 10 | 10 | 17 | 8 | 5 |
| SG167 | P238Y | 18 | 14 | 38 | 22 | 14 |
| SG168 | P238E | 21 | 16 | 30 | 28 | 13 |
| SG169 | P238M | 17 | 16 | 32 | 22 | 22 |
| SG170 | P238Q | 16 | 15 | 21 | 18 | 12 |
| SG171 | S239P | 17 | 20 | 18 | 20 | 8 |
| SG172 | V266F | 14 | 17 | 27 | 16 | 31 |
| SG173 | S267L | 13 | 14 | 21 | 12 | 24 |

TABLE 16-continued

Binding profile of selected substitutions to cynoFcγRs

| | | Binding to cynoFcgRs (SG1 = 100) | | | | |
|---|---|---|---|---|---|---|
| CH Name | Substitution | FcgRIIa1 | FcgRIIa2 | FcgRIIa3 | FcgRIIb | FcgRIIIaS |
| SG174 | S267H | 13 | 16 | 20 | 11 | 15 |
| SG175 | N325F | 13 | 13 | 17 | 14 | 8 |
| SG176 | N325I | 14 | 15 | 19 | 16 | 20 |
| SG177 | N325L | 15 | 15 | 25 | 18 | 21 |
| SG178 | N325E | 22 | 21 | 29 | 26 | 36 |
| SG179 | A327I | 19 | 17 | 28 | 19 | 48 |

Among selected 16 Fc variants, only MY001 maintained binding to cynoFcγRIIb by 85% compared to SG1. Additionally MY001 showed reduced binding to cynoFcγRIIIaS and its binding to cynoFcγRIIa1, IIa2, and IIa3 is maintained. As a result, G236N mutation is the unique substitution which shows similar binding profile to both human and cynoFcγRs.

Although G236N substitution shows cross-reactivity to both human and cyno FcγRs, its affinity to FcγRIIb is lower than SG1 (75% for human FcγRIIb and 85% for cynoFcγRIIb, respectively). In order to increase its affinity to FcγRIIb, additional substitutions were evaluated. Specifically, substitutions that showed increased binding to human FcγRIIb, reduced binding to human FcγRIIIa and increased selectivity to human FcγRIIb over human FcγRIIa were selected based on the result of comprehensive mutagenesis study (Table 17),

TABLE 17

Binding profile of additionally selected substitutions to human FcγRs

| | Binding to human FcgRs (parent B3 = 100) | | | |
|---|---|---|---|---|
| Mutation | FcgRIIaH | FcgRIIaR | FcgRIIb | FcgRIIIaV |
| L234W | 64 | 63 | 90 | 36 |
| L234Y | 38 | 50 | 55 | 63 |
| L235W | 136 | 128 | 130 | 40 |
| G236D | 109 | 91 | 212 | 25 |
| G236A | 165 | 168 | 94 | 65 |
| G236E | 142 | 131 | 117 | 33 |
| G236S | 147 | 161 | 87 | 33 |
| S239N | 99 | 80 | 124 | 111 |
| S239I | 82 | 75 | 108 | 47 |
| S239V | 79 | 71 | 107 | 48 |
| S267A | 176 | 125 | 283 | 145 |
| H268D | 173 | 142 | 307 | 220 |
| H268E | 169 | 132 | 283 | 205 |
| P271G | 152 | 130 | 252 | 93 |
| P271D | 94 | 55 | 110 | 85 |
| P271E | 90 | 51 | 105 | 87 |
| Q295L | 128 | 148 | 156 | 135 |
| S298L | 99 | 71 | 114 | 51 |
| K326T | 138 | 127 | 195 | 164 |
| A327N | 95 | 48 | 123 | 32 |
| L328T | 156 | 135 | 179 | 53 |
| A330R | 116 | 123 | 92 | 73 |
| A330K | 121 | 127 | 96 | 86 |
| P331E | 96 | 67 | 100 | 46 |
| I332D | 129 | 139 | 198 | 235 |
| K334I | 169 | 137 | 174 | 187 |
| K334V | 172 | 132 | 184 | 176 |
| K334Y | 157 | 131 | 160 | 188 |
| K334M | 151 | 127 | 148 | 183 |
| K334D | 97 | 72 | 108 | 155 |

Among these substitutions, L234W and L234Y were selected for increasing selectivity to human FcγRIIb over human FcγRIIa. And G236A, G236S, A330R, A330K and P331E were selected for decreasing binding to human FcγRIIIa. All other substitutions were selected for increasing binding to human FcγRIIb. The cross-reactivity of the selected substitutions to cynoFcγRs were evaluated. In addition, three substitutions, P396M, V264I, and E233D were also evaluated. The substitutions were introduced into M103205H795-SG1 and the variants were expressed using M103202L889-SK1 as light chain.

Table 18 shows kinetic analysis of selected substitutions including G236N against both human and cynoFcγRs. Specifically, substitutions were introduced into M103205H795-SG1. The variants were expressed using M103202L889-SK1 as light chain and their affinity to cynoFcγRIIa1, IIa2, IIa3, IIb, IIIaS were analyzed. The KD values in cells filled in gray were calculated using [Equation 2] since their affinity was too weak to be correctly determined by kinetic analysis. Values of KD fold were calculated by dividing the KD value of SG1 by the KD value of the variant for each FcγR.

G236N showed comparable binding affinity to cynoFcγRIIa1, cynoFcγRIIa2, cynoFcγRIIa3, and cynoFcγRIIb to SG1. Although the affinity to human FcγRIIb is reduced to 0.6-fold, affinities to human FcγRIIaH and human FcγRIIaR are reduced to 0.2-fold and 0.1-fold, respectively, indicating that this substitution has high selectivity to human FcγRIIb over human FcγRIIa. Furthermore, its affinities to cynoFcγRIIIaS and human FcγRIIIaV are 0.03-fold and 0.04-fold, respectively, which is favorable for eliminating ADCC activity. Based on this result, G236N showed almost ideal cross-reactivity to human and cynoFcγRs although its affinity to both human and cynoFcγRIIb should be enhanced.

Among additional substitutions evaluated, S298L, G236A, P331E, E233D, K334Y, K334M, L235W, S239V, K3341, L234W, K328T, Q295L, K334V, K326T, P396M, I332D, H268E, P271G, S267A and H268D showed increased binding to both human and cynoFcγRIIb. Specifically, H268D showed the largest effect (7-fold for human FcγRIIb and 5.3-fold for cynoFcγRIIb). With respect to the effect of reduction in FcγRIIIa binding, G236S, A330K, and G236D showed less than 0.5-fold affinity compared to SG1.

In order to enhance the affinity to both human and cynoFcγRIIb of MY001, combinations of substitutions listed in Table 18 were evaluated. Specifically, substitutions were introduced into M103205H795-SG1. The variants were expressed using M103202L889-SK1 as the light chain and their affinity was analyzed. Table 19 shows the result of kinetic analysis against human and cynoFcγRs. The KD values in cells filled in gray were calculated using [Equation 2] since their affinity was too weak to be correctly

TABLE 18

Kinetic analysis of variants against human and cynoFcγRs

| Heavy chain name | Sub- stitution | KD (M) for cynoFcgRs | | | | | KD (M) for humanFcgRs | | | |
|---|---|---|---|---|---|---|---|---|---|---|
| | | FcgRIIa2 | FcgRIIa2 | FcgRIIa3 | FcgRIIb | FcgRIIIaS | FcgRIIaH | FcgRIIaR | FcgRIIb | FcgRIIIaV |
| M103205H795-SG1 | — | 3.2E−06 | 5.1E−06 | 1.7E−05 | 1.8E−06 | 3.6E−07 | 6.9E−07 | 1.1E−06 | 4.6E−06 | 8.1E−07 |
| M103205H795-MY016 | E233D | 2.9E−06 | 3.4E−06 | 3.2E−06 | 1.7E−06 | 2.3E−07 | 8.5E−07 | 9.4E−07 | 2.9E−06 | 3.7E−07 |
| M103205H795-MY006 | L234W | 2.0E−06 | 1.9E−06 | 3.6E−06 | 9.2E−07 | 3.2E−07 | 1.3E−06 | 1.8E−06 | 2.3E−06 | 7.3E−07 |
| M103205H795-MY013 | L234Y | 4.5E−06 | 4.7E−06 | 5.2E−05 | 2.0E−06 | 3.3E−07 | 2.6E−06 | 5.1E−06 | 3.7E−06 | 4.1E−07 |
| M103205H795-MY070 | L235W | 2.3E−06 | 2.8E−06 | 4.7E−06 | 1.2E−06 | 4.9E−07 | 5.0E−07 | 7.4E−07 | 2.6E−06 | 7.0E−07 |
| M103205H795-MY001 | G236N | 2.9E−06 | 3.6E−06 | 1.5E−05 | 1.8E−06 | 1.2E−05 | 3.2E−06 | 8.2E−06 | 7.7E−06 | 1.8E−05 |
| M103205H795-MY061 | G236D | 6.5E−06 | 6.8E−06 | 1.8E−05 | 4.2E−06 | 3.4E−06 | 1.4E−06 | 1.3E−06 | 2.5E−06 | 3.0E−06 |
| M103205H795-MY071 | G236E | 5.0E−06 | 3.7E−06 | 9.2E−06 | 2.5E−06 | 2.8E−07 | 4.0E−07 | 4.5E−07 | 3.1E−06 | 5.1E−07 |
| M103205H795-MY074 | G236A | 2.0E−06 | 2.3E−06 | 6.2E−06 | 1.1E−06 | 2.7E−07 | 9.2E−08 | 2.1E−07 | 3.6E−06 | 5.6E−07 |
| M103205H795-MY124 | G236S | 2.6E−06 | 3.1E−06 | 1.2E−05 | 2.2E−06 | 1.3E−06 | 1.4E−07 | 5.2E−07 | 9.2E−06 | 5.2E−06 |
| M103205H795-MY008 | S239V | 4.2E−06 | 3.7E−06 | 2.4E−05 | 1.7E−06 | 3.7E−07 | 1.6E−06 | 1.8E−06 | 2.6E−06 | 6.3E−07 |
| M103205H795-MY037 | S239N | 3.8E−06 | 4.5E−06 | 9.6E−06 | 2.4E−06 | 2.0E−07 | 1.1E−06 | 9.1E−07 | 2.6E−06 | 3.7E−07 |
| M103205H795-MY038 | S239I | 3.9E−06 | 4.5E−06 | 1.1E−05 | 1.9E−06 | 3.1E−07 | 1.2E−06 | 1.5E−06 | 2.6E−06 | 5.5E−07 |
| M103205H795-MY010 | V264I | 3.5E−06 | 5.0E−06 | 1.6E−05 | 2.0E−06 | 2.2E−07 | 1.2E−06 | 1.8E−06 | 5.1E−06 | 2.2E−07 |
| M103205H795-MY011 | S267A | 2.3E−06 | 2.8E−06 | 9.9E−06 | 1.0E−06 | 1.5E−07 | 4.9E−07 | 1.7E−07 | 6.6E−07 | 3.4E−07 |
| M103205H795-MY017 | H268E | 2.7E−06 | 2.9E−06 | 5.5E−06 | 6.8E−07 | 9.8E−08 | 4.5E−07 | 2.8E−07 | 9.4E−07 | 1.4E−07 |
| M103205H795-MY063 | H268D | 1.4E−06 | 1.5E−06 | 2.0E−06 | 3.4E−07 | 6.7E−08 | 2.7E−07 | 2.1E−07 | 6.6E−07 | 1.6E−07 |
| M103205H795-MY012 | P271G | 2.1E−06 | 2.3E−06 | 7.9E−06 | 1.1E−06 | 2.0E−07 | 4.4E−07 | 2.3E−07 | 9.0E−07 | 4.8E−07 |
| M103205H795-MY040 | P271D | 5.5E−06 | 1.1E−05 | 4.4E−06 | 3.5E−06 | 3.7E−07 | 1.8E−06 | 1.2E−06 | 3.0E−06 | 6.1E−07 |
| M103205H795-MY041 | P271E | 4.0E−06 | 4.1E−06 | 7.4E−06 | 3.5E−06 | 2.6E−07 | 1.8E−06 | 1.2E−06 | 3.1E−06 | 4.8E−07 |
| M103205H795-MY073 | Q295L | 1.2E−06 | 1.3E−06 | 5.1E−06 | 6.7E−07 | 1.7E−07 | 2.4E−07 | 5.0E−07 | 2.0E−06 | 3.4E−07 |
| M103205H795-MY042 | S298L | 5.1E−07 | 3.1E−06 | 8.0E−06 | 1.6E−06 | 4.4E−07 | 1.0E−06 | 9.8E−07 | 4.0E−06 | 5.3E−07 |
| M103205H795-MY069 | K326T | 1.6E−06 | 1.6E−06 | 6.5E−06 | 7.3E−07 | 8.6E−08 | 4.4E−07 | 3.9E−07 | 1.6E−06 | 2.4E−07 |
| M103205H795-MY043 | A327N | 5.8E−06 | 6.1E−06 | 1.8E−05 | 4.4E−06 | 8.4E−07 | 2.9E−06 | 1.5E−06 | 3.0E−06 | 1.2E−06 |
| M103205H795-MY068 | L328T | 2.1E−06 | 2.7E−06 | 5.7E−06 | 1.0E−06 | 5.8E−07 | 3.7E−07 | 5.2E−07 | 2.1E−06 | 1.4E−06 |
| M103205H795-MY014 | A330R | 2.5E−06 | 2.5E−06 | 1.2E−05 | 1.5E−06 | 4.0E−07 | 5.2E−07 | 9.6E−07 | 4.8E−06 | 6.9E−07 |
| M103205H795-MY196 | A330K | 2.5E−06 | 3.0E−06 | 2.3E−05 | 2.4E−06 | 6.0E−07 | 4.8E−07 | 1.3E−06 | 3.2E−06 | 2.2E−06 |
| M103205H795-MY044 | P331E | 3.2E−06 | 3.5E−06 | 5.2E−05 | 1.6E−06 | 4.7E−07 | 1.2E−06 | 9.2E−07 | 3.3E−06 | 9.0E−07 |
| M103205H795-MY072 | I332D | 1.0E−06 | 1.2E−06 | 2.6E−06 | 4.8E−07 | 5.3E−08 | 2.5E−07 | 4.8E−07 | 1.5E−06 | 1.2E−07 |
| M103205H795-MY045 | K334D | 5.7E−06 | 4.0E−06 | 6.8E−06 | 2.2E−06 | 1.4E−07 | 1.6E−06 | 1.6E−06 | 2.9E−06 | 2.4E−07 |
| M103205H795-MY064 | K334I | 2.4E−06 | 2.6E−06 | 6.9E−06 | 1.1E−06 | 1.2E−07 | 5.0E−07 | 6.8E−07 | 2.4E−06 | 2.2E−07 |
| M103205H795-MY065 | K334V | 2.3E−06 | 2.8E−06 | 4.2E−06 | 1.3E−06 | 1.1E−07 | 5.2E−07 | 5.1E−07 | 1.9E−06 | 2.3E−07 |
| M103205H795-MY066 | K334Y | 2.1E−06 | 2.6E−06 | 6.7E−06 | 1.4E−06 | 1.6E−07 | 6.4E−07 | 9.7E−07 | 2.8E−06 | 2.9E−07 |
| M103205H795-MY067 | K334M | 2.1E−06 | 2.3E−06 | 6.7E−06 | 1.1E−06 | 1.0E−07 | 5.3E−07 | 7.6E−07 | 2.8E−06 | 2.0E−07 |
| M103205H795-MY015 | P396M | 1.3E−06 | 1.5E−06 | 4.7E−06 | 6.0E−07 | 1.0E−07 | 3.3E−07 | 3.2E−07 | 1.6E−06 | 2.4E−07 |

TABLE 18-continued

Kinetic analysis of variants against human and cynoFcγRs

| Heavy chain name | KD fold for cynoFcgRs (SG1 = 1) | | | | | KD fold for humanFcgRs (SG1 = 1) | | | |
|---|---|---|---|---|---|---|---|---|---|
| | FcgRIIa1 | FcgRIIa2 | FcgRIIa3 | FcgRIIb | FcgRIIIaS | FcgRIIaH | FcgRIIaR | FcgRIIb | FcgRIIIaV |
| M103205H795-SG1 | 1.0 | 1.0 | 1.0 | 1.0 | 1.00 | 1.0 | 1.0 | 1.0 | 1.00 |
| M103205H795-MY016 | 1.1 | 1.5 | 5.3 | 1.1 | 1.57 | 0.8 | 1.2 | 1.6 | 2.19 |
| M103205H795-MY006 | 1.6 | 2.7 | 4.7 | 2.0 | 1.13 | 0.5 | 0.6 | 2.0 | 1.11 |
| M103205H795-MY013 | 0.7 | 1.1 | 0.3 | 0.5 | 1.09 | 0.3 | 0.2 | 1.2 | 1.98 |
| M103205H795-MY070 | 1.0 | 1.8 | 3.6 | 1.5 | 0.73 | 1.4 | 1.5 | 1.8 | 1.16 |
| M103205H795-MY001 | 1.1 | 1.4 | 1.1 | 1.0 | 0.03 | 0.2 | 0.1 | 6.6 | 0.04 |
| M103205H795-MY061 | 0.5 | 0.8 | 0.5 | 0.4 | 0.11 | 0.5 | 0.8 | 1.8 | 0.27 |
| M103205H795-MY071 | 0.6 | 1.4 | 1.8 | 0.7 | 1.29 | 1.7 | 2.4 | 1.5 | 1.59 |
| M103205H795-MY074 | 1.6 | 2.2 | 2.7 | 1.6 | 1.33 | 7.5 | 5.2 | 1.3 | 1.45 |
| M103205H795-MY124 | 1.2 | 1.6 | 1.4 | 0.8 | 0.28 | 4.5 | 2.1 | 0.5 | 0.16 |
| M103205H795-MY008 | 0.8 | 1.4 | 0.7 | 1.1 | 0.97 | 0.4 | 0.6 | 1.8 | 1.29 |
| M103205H795-MY037 | 0.8 | 1.1 | 1.6 | 0.8 | 1.80 | 0.6 | 1.2 | 1.8 | 2.19 |
| M103205H795-MY038 | 0.8 | 1.1 | 1.5 | 0.9 | 1.16 | 0.6 | 0.7 | 1.8 | 1.47 |
| M103205H795-MY010 | 0.9 | 1.0 | 1.1 | 0.9 | 1.64 | 0.6 | 0.6 | 0.9 | 3.68 |
| M103205H795-MY011 | 1.4 | 1.6 | 1.7 | 1.8 | 2.40 | 1.4 | 6.5 | 7.0 | 2.38 |
| M103205H795-MY017 | 1.2 | 1.6 | 3.1 | 2.6 | 3.67 | 1.5 | 3.9 | 4.5 | 5.79 |
| M103205H795-MY063 | 2.3 | 3.4 | 8.5 | 5.3 | 5.37 | 2.6 | 5.2 | 7.0 | 5.06 |
| M103205H795-MY012 | 1.5 | 2.2 | 2.2 | 1.6 | 1.80 | 1.6 | 4.0 | 5.1 | 1.69 |
| M103205H795-MY040 | 0.6 | 0.5 | 3.9 | 0.5 | 0.97 | 0.4 | 0.9 | 1.5 | 1.33 |
| M103205H795-MY041 | 0.8 | 1.2 | 2.3 | 0.5 | 1.38 | 0.4 | 0.9 | 1.5 | 1.69 |
| M103205H795-MY073 | 2.7 | 3.9 | 3.3 | 2.7 | 2.12 | 2.9 | 2.2 | 2.3 | 2.38 |
| M103205H795-MY042 | 6.3 | 1.6 | 2.1 | 1.1 | 0.82 | 0.7 | 1.1 | 1.2 | 1.53 |
| M103205H795-MY069 | 2.0 | 3.2 | 2.6 | 2.5 | 4.19 | 1.6 | 2.8 | 2.9 | 3.38 |
| M103205H795-MY043 | 0.6 | 0.1 | 0.5 | 0.4 | 0.43 | 0.2 | 0.7 | 1.5 | 0.68 |
| M103205H795-MY068 | 1.5 | 1.9 | 3.0 | 1.8 | 0.62 | 1.9 | 2.1 | 2.2 | 0.58 |
| M103205H795-MY014 | 1.3 | 2.0 | 1.4 | 1.2 | 0.90 | 1.3 | 1.1 | 1.0 | 1.17 |
| M103205H795-MY196 | 1.3 | 1.7 | 0.7 | 0.8 | 0.60 | 1.4 | 0.8 | 0.7 | 0.37 |
| M103205H795-MY044 | 1.0 | 1.5 | 0.3 | 1.1 | 0.77 | 0.6 | 1.2 | 1.4 | 0.90 |
| M103205H795-MY072 | 3.2 | 4.3 | 6.5 | 3.8 | 6.79 | 2.8 | 2.3 | 3.1 | 6.79 |
| M103205H795-MY045 | 0.6 | 1.3 | 2.5 | 0.8 | 2.57 | 0.4 | 0.7 | 1.6 | 3.38 |
| M103205H795-MY064 | 1.3 | 2.0 | 2.5 | 1.6 | 3.00 | 1.4 | 1.6 | 1.9 | 3.68 |
| M103205H795-MY065 | 1.4 | 1.8 | 4.0 | 1.4 | 3.27 | 1.3 | 2.2 | 2.4 | 3.52 |
| M103205H795-MY066 | 1.5 | 2.0 | 2.5 | 1.3 | 2.25 | 1.1 | 1.1 | 1.6 | 2.79 |
| M103205H795-MY067 | 1.5 | 2.2 | 2.5 | 1.6 | 3.60 | 1.3 | 1.4 | 1.6 | 4.05 |
| M103205H795-MY015 | 2.5 | 3.4 | 3.6 | 3.0 | 3.60 | 2.1 | 3.4 | 2.9 | 3.38 |

TABLE 19

Kinetic analysis of variants which are composed of G236N and additional substitutions

| Heavy chain name | Substitutions | KD (M) for cynoFcgRs | | | | | KD (M) for humanFcgRs | | | |
|---|---|---|---|---|---|---|---|---|---|---|
| | | FcgRIIa1 | FcgRIIa2 | FcgRIIa3 | FcgRIIb | FcgRIIIa5 | FcgRIIaH | FcgRIIaR | FcgRIIb | FcgRIIIaV |
| M103205H795-SG1 | — | 3.2E−06 | 5.1E−06 | 1.7E−05 | 1.8E−06 | 5.6E−07 | 6.9E−07 | 1.1E−06 | 4.6E−06 | 8.1E−07 |
| M103205H795-MY001 | G236N | 2.9E−06 | 3.6E−06 | 1.5E−05 | 1.8E−06 | 3.2E−05 | 3.2E−06 | 8.2E−06 | 7.7E−06 | 1.8E−05 |
| M103205H795-MY047 | G236N/P271G | 4.8E−06 | 3.4E−06 | 2.4E−05 | 2.6E−06 | 7.6E−06 | 2.8E−06 | 3.8E−06 | 8.7E−06 | 7.7E−06 |
| M103205H795-MY048 | G236N/P396M | 1.4E−06 | 1.7E−06 | 7.0E−06 | 9.1E−07 | 5.4E−06 | 1.1E−06 | 3.1E−06 | 3.3E−06 | 1.2E−05 |
| M103205H795-MY049 | G236N/H268E | 2.7E−06 | 2.3E−06 | 6.6E−06 | 8.5E−07 | 4.5E−06 | 1.8E−06 | 7.8E−06 | 1.5E−06 | 7.8E−06 |
| M103205H795-MY050 | G236N/S267A/H268E | 4.3E−06 | 4.2E−06 | 1.9E−05 | 1.4E−06 | 1.7E−06 | 2.1E−06 | 1.5E−06 | 7.5E−07 | 3.3E−06 |
| M103205H795-MY051 | G236N/H268E/P271G | 4.5E−06 | 4.8E−06 | 1.8E−05 | 1.9E−06 | 2.1E−06 | 2.2E−06 | 2.8E−06 | 2.0E−06 | 7.4E−06 |
| M103205H795-MY052 | G236N/H268E/P396M | 1.4E−06 | 1.5E−06 | 3.9E−06 | 4.6E−07 | 1.5E−06 | 8.3E−07 | 1.4E−06 | 7.2E−07 | 4.6E−06 |
| M103205H795-MY101 | G236N/H268E/A330K/P396M | 1.1E−06 | 1.2E−06 | 3.6E−06 | 3.5E−07 | 3.2E−06 | 4.9E−07 | 8.7E−07 | 4.9E−07 | 1.1E−05 |
| M103205H795-MY103 | G236N/H268E/A330K/P396M | 1.4E−06 | 1.3E−06 | 3.6E−06 | 3.8E−07 | 2.6E−06 | 4.1E−07 | 1.2E−06 | 7.2E−07 | 4.5E−06 |
| M103205H795-MY105 | G236N/S239V/H268E/P396M | 1.2E−06 | 9.0E−07 | 1.5E−06 | 3.9E−07 | 1.3E−06 | 1.5E−06 | 1.4E−06 | 5.7E−07 | 5.9E−06 |
| M103205H795-MY107 | G236N/S239V/H268E/A330R/P396M | 9.0E−07 | 7.3E−07 | 1.2E−06 | 3.0E−07 | 2.2E−06 | 9.5E−07 | 1.4E−06 | 5.0E−07 | 5.5E−06 |
| M103205H795-MY109 | G236N/S239V/H268E/A330K/P396M | 8.7E−07 | 7.1E−07 | 1.2E−06 | 2.8E−07 | 2.0E−06 | 9.4E−07 | 1.5E−06 | 5.5E−07 | 4.2E−06 |
| M103205H795-MY111 | L234W/G236N/H268E/A330K/P396M | 1.7E−06 | 1.8E−06 | 4.2E−06 | 5.5E−07 | 2.3E−06 | 4.7E−07 | 2.0E−06 | 1.1E−06 | 4.1E−06 |
| M103205H795-MY113 | L234W/G236N/H268E/A330R/P396M | 1.6E−06 | 1.7E−06 | 4.0E−06 | 5.0E−07 | 2.0E−06 | 1.3E−06 | 1.8E−06 | 9.8E−07 | 5.7E−06 |
| M103205H795-MY115 | G236N/S267A/H268E/P396M | 2.3E−06 | 2.7E−06 | 7.6E−06 | 7.8E−07 | 8.5E−07 | 9.6E−07 | 6.4E−07 | 3.2E−07 | 8.6E−06 |
| M103205H795-MY117 | L234W/G236N/S267A/H268E/P396M | 2.6E−06 | 3.2E−06 | 9.9E−06 | 1.0E−06 | 1.0E−06 | 2.2E−06 | 1.0E−06 | 6.0E−07 | 7.9E−06 |
| M103205H795-MY141 | G236N/S267A/P396M | 2.2E−06 | 2.8E−06 | 2.0E−05 | 1.8E−06 | 4.7E−06 | 1.3E−06 | 1.6E−06 | 1.1E−06 | 1.2E−05 |
| M103205H795-MY144 | G236N/H268D/P396M | 8.9E−07 | 8.9E−07 | 3.8E−05 | 4.4E−07 | 2.5E−06 | 6.5E−07 | 1.5E−06 | 7.4E−07 | 7.7E−06 |
| M103205H795-MY145 | G236N/H268E/P331E/P396M | 1.9E−06 | 2.4E−06 | 1.0E−05 | 9.8E−07 | 3.6E−06 | 1.8E−06 | 2.5E−06 | 1.2E−06 | 9.1E−06 |
| M103205H795-MY146 | G236N/H268E/S298L/P396M | 1.7E−07 | 1.8E−06 | 4.8E−06 | 8.5E−07 | 3.1E−06 | 2.2E−06 | 2.1E−06 | 8.8E−07 | 8.8E−06 |
| M103205H795-MY147 | L235W/G236N/H268E/P396M | 2.2E−06 | 2.2E−06 | 6.6E−06 | 9.6E−07 | 5.5E−06 | 1.2E−06 | 1.1E−06 | 8.3E−07 | 1.1E−05 |
| M103205H795-MY197 | G236N/H268D/A330K/P396M | 5.8E−07 | 5.6E−07 | 1.4E−06 | 1.7E−07 | 2.1E−06 | 1.6E−07 | 7.1E−07 | 8.9E−07 | 1.0E−05 |
| M103205H795-MY198 | G236N/S239V/H268D/A330K/P396M | 4.4E−07 | 3.3E−07 | 1.4E−06 | 2.4E−07 | 2.7E−06 | 5.8E−07 | 8.0E−07 | 4.2E−07 | 6.9E−06 |
| M103205H795-MY199 | G236N/H268E/A330K | 1.9E−06 | 2.0E−06 | 1.2E−05 | 1.1E−06 | 4.1E−08 | 1.1E−06 | 2.8E−06 | 1.9E−06 | 1.3E−05 |
| M103205H795-MY200 | G236N/S2369V/H268E/A330K | 1.7E−06 | 1.5E−06 | 5.0E−06 | 1.1E−06 | 4.4E−06 | 1.7E−06 | 2.7E−06 | 1.4E−06 | 1.5E−05 |
| M103205H795-MY201 | G236N/H268D/A330K | 1.4E−06 | 1.4E−06 | 5.9E−06 | 4.3E−07 | 5.7E−06 | 9.1E−07 | 1.9E−06 | 1.1E−06 | 2.4E−05 |
| M103205H795-MY202 | G236N/S239V/H268D/A330K | 8.6E−07 | 6.4E−07 | 2.2E−06 | 4.6E−07 | 4.0E−06 | 1.2E−06 | 1.2E−06 | 7.1E−07 | 9.4E−06 |
| M103205H795-MY204 | G236N/S239V/H268E/Q295L/A330K | 1.3E−06 | 1.4E−06 | 5.2E−06 | 8.1E−07 | 3.5E−06 | 1.3E−06 | 2.8E−06 | 1.5E−06 | 1.1E−05 |
| M103205H795-MY205 | G236N/H268D/Q295L/A330K | 9.0E−07 | 1.1E−06 | 3.0E−06 | 2.5E−07 | 6.0E−06 | 4.7E−07 | 1.3E−06 | 5.8E−07 | 1.3E−05 |
| M103205H795-MY206 | G236N/S239V/H268D/Q295L/A330K | 8.1E−07 | 7.9E−07 | 3.0E−06 | 4.5E−07 | 3.5E−06 | 1.0E−06 | 1.4E−06 | 9.0E−07 | 8.2E−06 |
| M103205H795-MY207 | G236N/H268D | 1.5E−06 | 1.4E−06 | 6.9E−06 | 8.3E−07 | 4.1E−06 | 1.3E−06 | 2.8E−06 | 1.5E−06 | 8.0E−06 |
| M103205H795-MY208 | G236N/H268D/Q295L | 1.2E−06 | 1.5E−06 | 6.7E−06 | 6.4E−07 | 2.8E−08 | 8.3E−07 | 2.1E−06 | 1.1E−06 | 1.0E−05 |
| M103205H795-MY209 | G236N/H268D/Q295L/K326T/A330K | 6.3E−07 | 6.9E−07 | 1.9E−06 | 1.9E−07 | 2.2E−06 | 5.7E−07 | 8.8E−07 | 5.0E−07 | 1.4E−05 |
| M103205H795-MY210 | G236N/H268D/K326T/A330K | 9.5E−07 | 8.4E−07 | 2.3E−06 | 2.8E−07 | 2.4E−06 | 8.8E−07 | 1.4E−06 | 9.8E−07 | 3.1E−05 |
| M103205H795-MY211 | G236N/S239V/H268D/K326T/A330K | 7.5E−07 | 5.8E−07 | 2.7E−06 | 4.7E−07 | 3.0E−06 | 1.1E−06 | 1.3E−06 | 8.2E−07 | 4.8E−05 |

TABLE 19-continued

Kinetic analysis of variants which are composed of G236N and additional substitutions

| | | | | | | | | | | |
|---|---|---|---|---|---|---|---|---|---|---|
| M103205H795-MY212 | G236N/S239V/H268D/Q295L/K326T/A330K | 5.6E−07 | 5.5E−07 | 2.9E−06 | 5.7E−07 | 2.6E−06 | 8.0E−07 | 1.3E−06 | 6.3E−07 | 6.5E−06 |
| M103205H795-MY288 | G236N/Q295L | 1.5E−06 | 2.0E−06 | 1.1E−05 | 1.2E−06 | 1.3E−05 | 1.4E−06 | 8.5E−06 | 5.1E−06 | 6.8E−05 |
| M103205H795-MY289 | G236N/A330K/P396M | 1.5E−06 | 1.5E−06 | 8.6E−06 | 7.4E−07 | 5.2E−06 | 8.3E−07 | 3.5E−06 | 2.9E−06 | 7.7E−06 |
| M103205H795-MY350 | L235W/G236N/H268E/A330K/P396M | 2.1E−06 | 2.2E−06 | 4.7E−06 | 6.1E−07 | 6.6E−06 | 9.6E−07 | 9.0E−07 | 6.7E−07 | 1.2E−05 |
| M103205H795-MY434 | L235W/G236N/H268D/A330K | 2.9E−06 | 2.4E−06 | 6.4E−06 | 7.4E−07 | 1.1E−05 | 1.6E−06 | 1.9E−08 | 1.4E−06 | 1.6E−05 |
| M103205H795-MY440 | L235W/G236N/H268D/Q295L/A330K | 1.6E−06 | 1.8E−06 | 4.8E−06 | 4.6E−07 | 9.3E−06 | 9.1E−07 | 1.1E−06 | 8.0E−07 | 2.7E−05 |
| M103205H795-MY518 | L235W/G256N/H268D/Q295L/K326T/A330K | 8.9E−07 | 9.0E−07 | 2.4E−06 | 2.6E−07 | 4.2E−06 | 8.5E−07 | 6.7E−07 | 4.8E−07 | 2.3E−05 |

| Heavy chain name | KD fold for cynoFcgRs (SG1 = 1) | | | | | KD fold for humanFcgRs (SG1 = 2) | | | |
|---|---|---|---|---|---|---|---|---|---|
| | FcgRIIa1 | FcgRIIa2 | FcgRIIa3 | FcgRIIb | FcgRIIIaS | FcgRIIaH | FcgRIIaR | FcgRIIb | FcgRIIIaV |
| M103205H795-SG1 | 1.0 | 1.0 | 1.0 | 1.0 | 1.00 | 1.0 | 1.0 | 1.0 | 1.00 |
| M103205H795-MY001 | 1.1 | 1.4 | 1.1 | 1.0 | 0.05 | 0.2 | 0.1 | 0.6 | 0.04 |
| M103205H795-MY047 | 0.7 | 1.5 | 0.7 | 0.7 | 0.05 | 0.2 | 0.3 | 1.2 | 0.11 |
| M103205H795-MY048 | 2.3 | 3.0 | 2.4 | 2.0 | 0.07 | 0.6 | 0.4 | 1.4 | 0.07 |
| M103205H795-MY049 | 1.2 | 2.2 | 2.6 | 2.1 | 0.08 | 0.4 | 0.1 | 3.1 | 0.10 |
| M103205H795-MY050 | 0.7 | 1.2 | 0.5 | 1.3 | 0.21 | 0.3 | 0.7 | 6.1 | 0.25 |
| M103205H795-MY051 | 0.7 | 1.1 | 0.9 | 0.9 | 0.17 | 0.3 | 0.4 | 2.3 | 0.11 |
| M103205H795-MY052 | 2.3 | 3.4 | 4.4 | 3.9 | 0.24 | 0.8 | 0.8 | 6.4 | 0.18 |
| M103205H795-MY101 | 2.9 | 4.3 | 4.7 | 5.1 | 0.11 | 1.4 | 1.3 | 9.4 | 0.07 |
| M103205H795-MY103 | 2.3 | 3.9 | 4.7 | 4.7 | 0.14 | 1.7 | 0.9 | 6.4 | 0.18 |
| M103205H795-MY105 | 2.7 | 5.7 | 13.1 | 4.6 | 0.28 | 0.5 | 0.8 | 8.1 | 0.14 |
| M103205H795-MY107 | 3.6 | 7.0 | 14.2 | 6.0 | 0.16 | 0.7 | 0.8 | 9.2 | 0.14 |
| M103205H795-MY109 | 3.7 | 7.2 | 14.2 | 6.4 | 0.18 | 0.7 | 0.8 | 8.4 | 0.19 |
| M103205H795-MY111 | 1.9 | 2.8 | 4.0 | 3.5 | 0.16 | 1.5 | 0.6 | 4.2 | 0.26 |
| M103205H795-MY113 | 2.0 | 3.0 | 4.3 | 3.6 | 0.18 | 0.5 | 0.6 | 4.7 | 0.22 |
| M103205H795-MY115 | 1.4 | 1.9 | 2.2 | 2.3 | 0.42 | 0.7 | 1.7 | 14.4 | 0.22 |
| M103205H795-MY117 | 1.2 | 1.6 | 1.7 | 1.8 | 0.36 | 0.5 | 1.1 | 7.7 | 0.10 |
| M103205H795-MY141 | 1.5 | 1.8 | 0.5 | 1.0 | 0.08 | 0.6 | 0.7 | 4.2 | 0.07 |
| M103205H795-MY144 | 3.6 | 5.7 | 4.5 | 4.1 | 0.16 | 1.1 | 0.8 | 6.2 | 0.11 |
| M103205H795-MY145 | 1.7 | 2.1 | 1.7 | 1.8 | 0.10 | 0.4 | 0.5 | 3.8 | 0.09 |
| M103205H795-MY146 | 18.8 | 2.8 | 3.5 | 2.1 | 0.12 | 0.3 | 0.5 | 5.2 | 0.09 |
| M103205H795-MY147 | 1.5 | 2.3 | 2.6 | 1.9 | 0.07 | 0.6 | 1.0 | 5.5 | 0.07 |
| M103205H795-MY197 | 5.5 | 9.1 | 12.1 | 10.6 | 0.17 | 1.9 | 1.5 | 11.8 | 0.08 |
| M103205H795-MY198 | 7.3 | 15.5 | 12.1 | 7.5 | 0.15 | 1.2 | 1.4 | 11.0 | 0.12 |
| M103205H795-MY199 | 1.7 | 2.6 | 1.4 | 1.6 | 0.09 | 0.6 | 0.4 | 2.4 | 0.06 |
| M103205H795-MY200 | 1.9 | 3.4 | 3.4 | 1.6 | 0.08 | 0.4 | 0.4 | 3.3 | 0.05 |
| M103205H795-MY201 | 2.3 | 3.6 | 4.4 | 4.2 | 0.06 | 0.8 | 0.6 | 4.7 | 0.03 |
| M103205H795-MY202 | 3.7 | 8.0 | 7.7 | 3.9 | 0.09 | 0.6 | 0.9 | 6.5 | 0.09 |

TABLE 19-continued

Kinetic analysis of variants which are composed of G236N and additional substitutions

| | | | | | | | | | |
|---|---|---|---|---|---|---|---|---|---|
| M103205H795-MY204 | 2.5 | 3.6 | 3.3 | 2.2 | 0.10 | 0.5 | 0.4 | 3.5 | 0.07 |
| M103205H795-MY205 | 3.6 | 4.6 | 5.7 | 7.2 | 0.08 | 1.5 | 0.8 | 8.7 | 0.06 |
| M103205H795-MY206 | 4.0 | 6.5 | 5.7 | 4.0 | 0.11 | 0.7 | 0.8 | 5.1 | 0.10 |
| M103205H795-MY207 | 2.1 | 3.6 | 2.5 | 2.2 | 0.09 | 0.5 | 0.4 | 2.9 | 0.10 |
| M103205H795-MY208 | 2.7 | 3.4 | 2.5 | 2.8 | 0.13 | 0.8 | 0.5 | 4.2 | 0.08 |
| M103205H795-MY209 | 5.1 | 7.4 | 8.9 | 9.5 | 0.16 | 1.2 | 1.3 | 9.2 | 0.06 |
| M103205H795-MY210 | 3.4 | 6.1 | 7.4 | 6.4 | 0.15 | 0.8 | 0.8 | 4.7 | 0.03 |
| M103205H795-MY211 | 4.3 | 8.8 | 6.5 | 3.8 | 0.12 | 0.6 | 0.8 | 5.6 | 0.17 |
| M103205H795-MY212 | 5.7 | 9.6 | 5.9 | 4.9 | 0.14 | 0.9 | 0.8 | 7.3 | 0.17 |
| M103205H795-MY288 | 2.1 | 2.6 | 1.5 | 1.5 | 0.03 | 0.5 | 0.1 | 0.9 | 0.01 |
| M103205H795-MY289 | 2.5 | 3.4 | 1.0 | 2.4 | 0.07 | 0.8 | 0.3 | 1.6 | 0.11 |
| M103205H795-MY350 | 1.5 | 2.3 | 3.6 | 3.2 | 0.05 | 0.7 | 1.2 | 6.9 | 0.07 |
| M103205H795-MY434 | 1.1 | 2.1 | 2.7 | 2.4 | 0.03 | 0.4 | 0.8 | 3.5 | 0.05 |
| M103205H795-MY440 | 2.0 | 2.8 | 3.5 | 3.9 | 0.04 | 0.8 | 1.0 | 5.8 | 0.03 |
| M103205H795-MY518 | 3.6 | 5.7 | 7.1 | 6.9 | 0.09 | 0.8 | 1.6 | 9.6 | 0.04 | determined by kinetic analysis. Values of KD fold were calculated by dividing the KD value of SG1 by the KD value of the variant for each FcγR.

All the variants suppressed affinities to human FcγRIIIaV by less than 0.26-fold and to cynoFcγRIIIaS by less than 0.42-fold compared to SG1. Furthermore, all the variants except for MY047, MY051, and MY141 successfully showed enhanced binding to both human and cynoFcγRIIb compared to MY001 and their human FcγRIIa binding were maintained to less than 2-fold compared to SG1. Among them, MY201, MY210, MY206, MY144, MY103, MY212, MY105, MY205, MY109, MY107, MY209, MY101, MY518, MY198 and MY197 showed enhanced binding both to human and cynoFcγRIIb by more than 4-fold compared to SG1. Above all, MY205, MY209, MY198, and MY197 showed enhanced binding to both human and cynoFcγRIIb binding by more than 7-fold.

It was illustrated in WO2014030728 that substitutions at position 396 in CH3 domain enhanced affinity to human FcγRIIb. Comprehensive mutagenesis was introduced into position 396 of M103205H795-MY052, which contains G236N/H268E/P396M substitutions. The resultant variants were expressed using M103202L889-SK1 as light chain and their affinity to human and cynoFcγRs were evaluated (Table 20). Values of KD fold were calculated by dividing the KD value of SG1 by the KD value of the variant for each FcγR.

Among substitutions tested, P3961, P396K, and P396L maintained human FcγRIIb binding by more than 5-fold compared to SG1 and only P396L substitution enhanced affinity to human FcγRIIb compared to MY052. With respect to the binding to cynoFcγRIIb, parent MY052 showed the highest affinity which is a 3.9-fold increase from SG1.

Since G236N showed ideal cross-reactivity to human and cynoFcγRs, other substitutions on position 236 which were not evaluated in the preceding examples were tested. Specifically, Asn in M103205H795-MY201 were substituted with Met, His, Val, Gln, Leu, Thr, and Ile. The resultant variants were expressed using M103202L889-SK1 as light chain and their affinity to human and cynoFcγRs were evaluated (Table 21). The KD values in cells filled in gray were calculated using [Equation 2]since their affinity was too weak to be correctly determined by kinetic analysis. Values of KD fold were calculated by dividing the KD value of SG1 by the KD value of the variant for each FcγR.

TABLE 20

Kinetic analysis of P396 variants derived from MY052

| | | KD (M) for cynoFcgRs | | | | |
|---|---|---|---|---|---|---|
| Heavy chain name | Substitutions | FcgRIIa1 | FcgRIIa2 | FcgRIIa3 | FcgRIIb | FcgRIIIaS |
| M103205H795-SG1 | — | 3.2E−06 | 5.1E−06 | 1.7E−06 | 1.8E−06 | 3.6E−07 |
| M103205H795-MY052 | G236N/H268E/P396M | 1.4E−06 | 1.5E−06 | 3.9E−06 | 4.6E−07 | 1.5E−06 |
| M103205H795-MY168 | G236N/H268E/P396A | 2.2E−06 | 2.5E−06 | 1.0E−06 | 1.2E−08 | 4.5E−06 |
| M103205H795-MY169 | G236N/H268E/P396D | 2.3E−05 | 2.3E−06 | 9.9E−06 | 1.0E−06 | 3.5E−06 |
| M103205H795-MY170 | G236N/H268E/P396E | 2.3E−05 | 2.4E−06 | 1.2E−06 | 1.2E−06 | 7.9E−06 |
| M103205H795-MY171 | G236N/H268E/P396F | 2.3E−06 | 2.3E−06 | 9.2E−06 | 9.8E−06 | 3.3E−06 |
| M103205H795-MY172 | G236N/H268E/P396G | 2.7E−06 | 2.8E−06 | 1.1E−06 | 1.2E−06 | 3.5E−06 |
| M103205H795-MY173 | G236N/H268E/P396H | 1.7E−06 | 1.8E−06 | 8.0E−06 | 7.3E−07 | 3.1E−06 |

TABLE 20-continued

Kinetic analysis of P396 variants derived from MY052

| | | | | | | |
|---|---|---|---|---|---|---|
| M103205H795-MY174 | G236N/H268E/P396I | 1.5E−06 | 1.6E−06 | 6.4E−06 | 6.5E−07 | 2.5E−06 |
| M103205H795-MY175 | G236N/H268E/P396K | 1.4E−06 | 1.5E−06 | 7.5E−06 | 7.1E−07 | 2.6E−06 |
| M103205H795-MY176 | G236N/H268E/P396L | 1.3E−06 | 1.4E−06 | 6.0E−06 | 6.1E−07 | 2.2E−06 |
| M103205H795-MY177 | G236N/H268E/P396N | 1.9E−06 | 1.8E−06 | 8.1E−06 | 8.3E−07 | 2.9E−06 |
| M103205H795-MY178 | G236N/H268E/P396Q | 2.0E−06 | 2.1E−06 | 8.7E−06 | 9.5E−07 | 3.0E−06 |
| M103205H795-MY179 | G236N/H268E/P396R | 1.9E−06 | 2.0E−06 | 7.9E−06 | 9.8E−07 | 2.7E−06 |
| M103205H795-MY180 | G236N/H268E/P396S | 2.6E−06 | 2.7E−06 | 1.2E−06 | 1.3E−06 | 3.1E−06 |
| M103205H795-MY181 | G236N/H268E/P396T | 2.3E−06 | 2.3E−06 | 9.2E−06 | 1.0E−06 | 4.1E−06 |
| M103205H795-MY182 | G236N/H268E/P396V | 2.1E−06 | 2.2E−06 | 7.8E−06 | 9.6E−07 | 3.6E−06 |
| M103205H795-MY183 | G236N/H268E/P396W | 2.1E−06 | 2.0E−06 | 8.4E−06 | 9.7E−07 | 3.5E−06 |
| M103205H795-MY184 | G236N/H268E/P396Y | 1.9E−06 | 2.0E−06 | 8.4E−06 | 9.0E−07 | 3.3E−06 |

| | KD (M) for humanFcgRs | | | | KD fold for cynoFcgRs (SG1 = 1) | | |
|---|---|---|---|---|---|---|---|
| Heavy chain name | FcgRIIaH | FcgRIIaR | FcgRIIb | FcgRIIIaV | FcgRIIa1 | FcgRIIa2 | FcgRIIa3 |
| M103205H795-SG1 | 6.9E−07 | 1.1E−06 | 4.6E−06 | 8.1E−07 | 1.0 | 1.0 | 1.0 |
| M103205H795-MY052 | 8.3E−07 | 1.4E−06 | 7.2E−07 | 1.5E−06 | 2.3 | 3.4 | 4.4 |
| M103205H795-MY168 | 1.6E−06 | 2.8E−06 | 1.7E−06 | 8.1E−06 | 1.5 | 2.0 | 1.7 |
| M103205H795-MY169 | 1.2E−06 | 2.5E−06 | 1.3E−06 | 6.2E−06 | 1.4 | 2.2 | 1.7 |
| M103205H795-MY170 | 1.7E−06 | 2.5E−06 | 1.6E−06 | 6.3E−06 | 1.4 | 2.1 | 1.4 |
| M103205H795-MY171 | 1.2E−06 | 2.3E−06 | 1.2E−06 | 5.9E−06 | 1.4 | 2.2 | 1.5 |
| M103205H795-MY172 | 1.7E−06 | 3.1E−06 | 1.8E−06 | 6.5E−06 | 1.2 | 1.8 | 1.5 |
| M103205H795-MY173 | 1.0E−06 | 1.9E−06 | 1.0E−06 | 7.0E−06 | 1.5 | 2.8 | 2.1 |
| M103205H795-MY174 | 8.1E−07 | 1.4E−06 | 8.5E−07 | 6.8E−06 | 2.1 | 3.2 | 2.7 |
| M103205H795-MY175 | 8.6E−07 | 1.5E−06 | 8.3E−07 | 7.5E−06 | 2.3 | 3.4 | 2.3 |
| M103205H795-MY176 | 7.0E−07 | 1.3E−06 | 7.0E−07 | 6.2E−06 | 2.5 | 3.6 | 2.8 |
| M103205H795-MY177 | 1.0E−06 | 2.0E−06 | 1.1E−06 | 6.2E−06 | 1.7 | 2.8 | 2.1 |
| M103205H795-MY178 | 1.2E−06 | 2.3E−06 | 1.3E−06 | 4.5E−06 | 1.6 | 2.4 | 2.0 |
| M103205H795-MY179 | 1.1E−06 | 2.1E−06 | 1.2E−06 | 5.9E−06 | 1.7 | 2.8 | 2.2 |
| M103205H795-MY180 | 1.7E−06 | 3.0E−06 | 1.9E−06 | 5.9E−06 | 1.7 | 1.9 | 1.4 |
| M103205H795-MY181 | 1.3E−06 | 2.5E−06 | 1.4E−06 | 7.3E−06 | 1.4 | 2.2 | 1.1 |
| M103205H795-MY182 | 1.3E−06 | 2.1E−06 | 1.2E−06 | 7.0E−06 | 1.5 | 2.3 | 2.2 |
| M103205H795-MY183 | 1.2E−06 | 2.1E−06 | 1.1E−06 | 7.7E−06 | 1.5 | 2.6 | 2.0 |
| M103205H795-MY184 | 1.1E−06 | 2.0E−06 | 1.1E−06 | 6.8E−06 | 1.7 | 2.8 | 2.0 |

| | KD fold for cynoFcgRs (SG1 = 1) | | KD fold for humanFcgRs (SG1 = 1) | | | |
|---|---|---|---|---|---|---|
| Heavy chain name | FcgRIIb | FcgRIIIaS | FcgRIIaH | FcgRIIaR | FcgRIIb | FcgRIIIaV |
| M103205H795-SG1 | 1.0 | 1.00 | 1.0 | 1.0 | 1.0 | 1.00 |
| M103205H795-MY052 | 3.5 | 0.24 | 0.8 | 0.1 | 6.4 | 0.54 |
| M103205H795-MY168 | 1.5 | 0.08 | 0.4 | 0.4 | 2.7 | 0.10 |
| M103205H795-MY169 | 1.8 | 0.10 | 0.6 | 0.4 | 3.5 | 0.13 |
| M103205H795-MY170 | 1.5 | 0.17 | 0.4 | 0.4 | 2.5 | 0.13 |
| M103205H795-MY171 | 1.5 | 0.11 | 0.5 | 0.5 | 3.8 | 0.14 |
| M103205H795-MY172 | 1.5 | 0.17 | 0.4 | 0.4 | 2.6 | 0.12 |
| M103205H795-MY173 | 2.3 | 0.12 | 0.7 | 0.6 | 4.6 | 0.12 |
| M103205H795-MY174 | 2.8 | 0.14 | 0.9 | 0.8 | 5.4 | 0.12 |
| M103205H795-MY175 | 2.5 | 0.14 | 0.8 | 0.7 | 5.5 | 0.11 |
| M103205H795-MY176 | 1.0 | 0.16 | 1.0 | 0.1 | 6.5 | 0.13 |
| M103205H795-MY177 | 2.2 | 0.12 | 0.7 | 0.1 | 4.2 | 0.13 |
| M103205H795-MY178 | 1.9 | 0.17 | 0.6 | 0.5 | 3.5 | 0.15 |
| M103205H795-MY179 | 1.8 | 0.13 | 0.6 | 0.5 | 3.8 | 0.14 |
| M103205H795-MY180 | 1.4 | 0.17 | 0.4 | 0.4 | 2.4 | 0.14 |
| M103205H795-MY181 | 1.8 | 0.09 | 0.5 | 0.4 | 3.3 | 0.11 |
| M103205H795-MY182 | 1.9 | 0.10 | 0.5 | 0.5 | 3.8 | 0.17 |
| M103205H795-MY183 | 1.9 | 0.10 | 0.6 | 0.5 | 4.7 | 0.11 |
| M103205H795-MY184 | 2.0 | 0.11 | 0.6 | 0.6 | 4.7 | 0.12 |

TABLE 21

Kinetic analysis of G236 variants derived from MY201

| | | KD (M) for cynoFcgRs | | | | |
|---|---|---|---|---|---|---|
| Heavy chain name | Substitutions | FcgRIIa1 | FcgRIIa2 | FcgRIIa3 | FcgRIIb | FcgRIIIaS |
| M103205H795-SG1 | — | 3.2E−06 | 5.1E−06 | 1.7E−05 | 1.8E−06 | 3.5E−07 |
| M103205H795-MY201 | G236N/H268D/A330K | 1.4E−06 | 1.4E−06 | 3.9E−05 | 4.3E−07 | 5.7E−06 |
| M103205H795-MY260 | G238M/H268D/A330K | 4.5E−06 | 3.7E−06 | 1.4E−05 | 1.6E−06 | 8.5E−07 |
| M103205H795-MY261 | G236H/H268D/A330K | 3.7E−06 | 4.0E−06 | 5.5E−05 | 1.5E−06 | 2.4E−06 |

TABLE 21-continued

Kinetic analysis of G236 variants derived from MY201

| | | | | | | | |
|---|---|---|---|---|---|---|---|
| M103205H795-MY262 | G236V/H268D/A330K | 1.5E−06 | 1.7E−06 | 8.0E−05 | 5.8E−07 | | 2.8E−06 |
| M103205H795-MY263 | G236Q/H268D/A330K | 3.2E−06 | 3.0E−06 | 7.3E−05 | 1.0E−06 | | 7.8E−07 |
| M103205H795-MY264 | G236L/H268D/A330K | 5.6E−06 | 5.5E−06 | 1.6E−05 | 2.6E−07 | | 3.7E−06 |
| M103205H795-MY265 | G236I/H268D/A330K | 2.2E−06 | 1.9E−06 | 4.3E−05 | 5.9E−07 | | 2.0E−06 |
| M103205H795-MY267 | G236L/H268D/A330K | 2.4E−06 | 2.0E−06 | 7.3E−05 | 6.4E−07 | | 2.7E−06 |

| | KD (M) for humanFcgRs | | | | KD fold for cynoFcgRs (SG1 = 1) | | |
|---|---|---|---|---|---|---|---|
| Heavy chain name | FcgRIIaH | FcgRIIaR | FcgRIIb | FcgRIIIaV | FcgRIIa1 | FcgRIIa2 | FcgRIIa3 |
| M103205H795-SG1 | 6.9E−07 | 1.1E−06 | 4.8E−06 | 8.1E−07 | 1.0 | 1.0 | 1.0 |
| M103205H795-MY201 | 9.1E−07 | 1.9E−06 | 1.1E−06 | 2.4E−05 | 2.3 | 3.6 | 4.4 |
| M103205H795-MY260 | 9.1E−07 | 1.8E−06 | 6.1E−06 | 3.0E−05 | 0.7 | 1.4 | 1.7 |
| M103205H795-MY261 | 2.4E−07 | 1.1E−06 | 5.3E−08 | 1.1E−05 | 0.9 | 1.3 | 3.1 |
| M103205H795-MY262 | 1.4E−07 | 7.1E−07 | 6.0E−06 | 5.0E−06 | 1.7 | 3.0 | 2.1 |
| M103205H795-MY263 | 3.2E−07 | 7.1E−07 | 3.5E−06 | 2.3E−06 | 1.0 | 1.7 | 2.3 |
| M103205H795-MY264 | 1.5E−07 | 2.3E−06 | 2.2E−05 | 6.4E−05 | 0.6 | 0.9 | 1.1 |
| M103205H795-MY265 | 2.1E−07 | 4.4E−07 | 2.7E−06 | 5.4E−05 | 1.5 | 2.7 | 3.5 |
| M103205H795-MY267 | 2.0E−07 | 7.1E−07 | 5.7E−06 | 1.5E−05 | 1.3 | 2.5 | 2.3 |

| | KD fold for cynoFcgRs (SG1 = 1) | | KD fold for humanFcgRs (SG1 = 1) | | | |
|---|---|---|---|---|---|---|
| Heavy chain name | FcgRIIb | FcgRIIIaS | FcgRIIaH | FcgRIIaR | FcgRIIb | FcgRIIIaV |
| M103205H795-SG1 | 1.0 | 1.00 | 1.0 | 1.0 | 1.0 | 1.00 |
| M103205H795-MY201 | 4.2 | 0.06 | 0.8 | 0.6 | 4.2 | 0.03 |
| M103205H795-MY260 | 1.1 | 0.55 | 0.8 | 0.6 | 0.8 | 0.27 |
| M103205H795-MY261 | 1.2 | 0.15 | 2.9 | 1.0 | 0.9 | 0.07 |
| M103205H795-MY262 | 3.2 | 0.35 | 4.9 | 1.5 | 0.3 | 0.16 |
| M103205H795-MY263 | 1.8 | 0.46 | 2.2 | 1.5 | 1.3 | 0.39 |
| M103205H795-MY264 | 0.7 | 0.10 | 0.5 | 0.5 | 0.4 | 0.01 |
| M103205H795-MY265 | 3.1 | 0.18 | 3.3 | 2.5 | 2.1 | 0.15 |
| M103205H795-MY267 | 2.1 | 0.13 | 3.5 | 1.5 | 0.8 | 0.05 |

TABLE 22

Kinetic analysis of variants derived from. MY265

| | | KD (M) for cynoFcgRs | | | | |
|---|---|---|---|---|---|---|
| Heavy chain name | Substitutions | FcgRIIa1 | FcgRIIa2 | FcgRIIa3 | FcgRIIb | FcgRIIIaS |
| M103205H795-SG1 | — | 3.2E−06 | 5.1E−06 | 1.7E−05 | 1.8E−06 | 3.6E−07 |
| M103205H795-MY265 | I236T/H268D/A330K | 2.2E−06 | 1.9E−06 | 4.8E−06 | 5.9E−07 | 2.0E−06 |
| M103205H795-MY459 | I231D/G236T/H268D/A330K | 5.0E−06 | 4.7E−06 | 7.5E−06 | 1.1E−06 | 3.2E−06 |
| M103205H795-MY460 | I231E/G236T/H268D/A330K | 3.1E−06 | 3.1E−06 | 5.5E−06 | 7.9E−07 | 2.7E−06 |
| M103205H795-MY461 | I231F/G236T/H268D/A330K | 1.8E−06 | 1.8E−06 | 3.5E−06 | 4.7E−07 | 2.1E−06 |
| M103205H795-MY462 | I231G/G236T/H268D/A330K | 1.9E−06 | 1.8E−06 | 4.2E−06 | 4.7E−07 | 1.8E−06 |
| M103205H795-MY463 | I231H/G236T/H268D/A330K | 2.1E−06 | 1.8E−06 | 4.4E−06 | 5.8E−07 | 1.6E−06 |
| M103205H795-MY464 | I231I/G236T/H268D/A330K | 1.9E−06 | 1.5E−06 | 3.9E−06 | 5.0E−07 | 1.7E−06 |
| M103205H795-MY465 | I231K/G236T/H268D/A330K | 2.0E−06 | 2.8E−06 | 5.2E−06 | 6.3E−07 | 1.9E−06 |
| M103205H795-MY466 | I231L/G236T/H268D/A330K | 1.9E−06 | 1.8E−06 | 4.4E−06 | 5.1E−07 | 1.8E−06 |
| M103205H795-MY467 | A231M/G236T/H268D/A330K | 1.9E−06 | 1.9E−06 | 4.7E−06 | 5.1E−07 | 1.7E−06 |
| M103205H795-MY468 | I231N/G236T/H268D/A330K | 2.8E−06 | 2.5E−06 | 5.2E−06 | 6.5E−07 | 2.3E−06 |
| M103205H795-MY469 | I231P/G236T/H268D/A330K | 2.2E−06 | 2.1E−06 | 4.9E−06 | 6.1E−07 | 2.2E−06 |
| M103205H795-MY470 | I231Q/G236T/H268D/A330K | 2.2E−06 | 1.8E−06 | 4.9E−06 | 5.5E−07 | 1.7E−06 |
| M103205H795-MY471 | I231R/G236T/H268D/A330K | 2.6E−06 | 2.1E−06 | 4.5E−06 | 7.0E−07 | 1.8E−06 |
| M103205H795-MY472 | I231S/G236T/H268D/A330K | 2.4E−06 | 2.1E−06 | 5.1E−06 | 6.6E−07 | 2.3E−06 |
| M103205H795-MY473 | A231T/G236T/H268D/A330K | 1.6E−06 | 2.6E−06 | 5.5E−06 | 5.8E−07 | 1.7E−06 |
| M103205H795-MY474 | I231V/G236T/H268D/A330K | 2.0E−06 | 1.8E−06 | 4.8E−06 | 5.0E−07 | 1.6E−06 |
| M103205H795-MY475 | I231W/G236T/H268D/A330K | 1.0E−06 | 1.0E−06 | 2.5E−06 | 2.7E−07 | 1.7E−06 |
| M103205H795-MY476 | I231Y/G236T/H268D/A330K | 1.4E−06 | 1.3E−06 | 2.6E−06 | 3.9E−07 | 2.0E−06 |
| M103205H795-MY441 | P232A/G236T/H268D/A330K | 3.9E−06 | 3.3E−06 | 8.0E−06 | 8.8E−07 | 2.6E−06 |
| M103205H795-MY442 | P232D/G236T/H268D/A330K | 4.4E−06 | 4.2E−06 | 6.8E−06 | 1.1E−06 | 2.1E−06 |
| M103205H795-MY443 | P232E/G236T/H268D/A330K | 4.8E−06 | 5.0E−06 | 8.8E−06 | 1.2E−06 | 2.6E−06 |
| M103205H795-MY444 | P232F/G236T/H268D/A330K | 1.2E−06 | 1.1E−06 | 1.9E−06 | 3.0E−07 | 1.6E−06 |
| M103205H795-MY445 | P232G/G236T/H268D/A330K | 5.6E−06 | 5.5E−06 | 1.4E−05 | 1.4E−06 | 3.5E−06 |
| M103205H795-MY446 | P232H/G236T/H268D/A330K | 2.5E−06 | 2.2E−06 | 6.3E−06 | 6.3E−07 | 2.9E−06 |
| M103205H795-MY447 | P232I/G236T/H268D/A330K | 9.9E−07 | 8.8E−07 | 1.5E−06 | 2.3E−07 | 1.1E−06 |
| M103205H795-MY448 | P232K/G236T/H268D/A330K | 9.6E−06 | 7.5E−06 | 2.1E−05 | 2.3E−06 | 6.5E−06 |
| M103205H795-MY449 | P232L/G236T/H268D/A330K | 8.7E−07 | 9.4E−07 | 1.5E−06 | 2.3E−07 | 1.0E−06 |
| M103205H795-MY450 | P232M/G236T/H268D/A330K | 1.3E−06 | 1.1E−06 | 2.2E−06 | 2.8E−07 | 1.3E−06 |
| M103205H795-MY451 | P232N/G236T/H268D/A330K | 3.6E−06 | 4.2E−06 | 6.7E−06 | 1.0E−06 | 2.7E−06 |

TABLE 22-continued

Kinetic analysis of variants derived from. MY265

| | | | | | | |
|---|---|---|---|---|---|---|
| M103205H795-MY452 | P232Q/G236T/H268D/A330K | 3.4E−06 | 3.1E−06 | 6.5E−06 | 9.2E−07 | 2.8E−06 |
| M103205H795-MY453 | P232R/G236T/H268D/A330K | 6.2E−06 | 9.9E−06 | 2.1E−05 | 2.1E−06 | 6.5E−06 |
| M103205H795-MY454 | P232S/G236T/H268D/A330K | 3.8E−06 | 3.1E−06 | 7.6E−06 | 1.0E−06 | 2.8E−06 |
| M103205H795-MY455 | P232T/G236T/H268D/A330K | 3.1E−06 | 2.9E−06 | 5.4E−06 | 9.2E−07 | 2.8E−06 |
| M103205H795-MY456 | P232V/G236T/H268D/A330K | 1.9E−06 | 1.7E−06 | 3.4E−06 | 5.2E−07 | 2.0E−06 |
| M103205H795-MY457 | P232W/G236T/H268D/A330K | 8.1E−07 | 8.4E−07 | 1.2E−06 | 2.0E−07 | 1.1E−06 |
| M103205H795-MY458 | P232Y/G236T/H268D/A330K | 1.8E−06 | 1.6E−06 | 3.0E−06 | 4.3E−07 | 1.9E−06 |

| | KD (M) for humanFcgRs | | | | KD fold for cynoFcgRs (SG1 = 1) | | |
|---|---|---|---|---|---|---|---|
| Heavy chain name | FcgRIIaH | FcgRIIaR | FcgRIIb | FcgRIIIaV | FcgRIIa1 | FcgRIIa2 | FcgRIIa3 |
| M103205H795-SG1 | 6.9E−07 | 1.1E−06 | 4.6E−06 | 8.1E−07 | 1.0 | 1.0 | 1.0 |
| M103205H795-MY265 | 2.1E−07 | 4.4E−07 | 2.2E−06 | 5.4E−06 | 1.5 | 2.7 | 3.5 |
| M103205H795-MY459 | 3.9E−07 | 5.6E−07 | 2.5E−06 | 8.7E−06 | 0.6 | 1.1 | 2.3 |
| M103205H795-MY460 | 2.6E−07 | 5.5E−07 | 2.4E−06 | 6.7E−06 | 1.0 | 1.6 | 3.1 |
| M103205H795-MY461 | 1.8E−07 | 3.4E−07 | 1.7E−06 | 5.4E−06 | 1.8 | 2.8 | 4.9 |
| M103205H795-MY462 | 2.4E−07 | 4.9E−07 | 1.9E−06 | 5.4E−06 | 1.7 | 3.2 | 4.0 |
| M103205H795-MY463 | 2.2E−07 | 5.1E−07 | 2.3E−06 | 4.8E−06 | 1.5 | 2.8 | 3.9 |
| M103205H795-MY464 | 1.7E−07 | 2.6E−07 | 1.6E−06 | 4.4E−06 | 1.7 | 3.4 | 4.4 |
| M103205H795-MY465 | 2.5E−07 | 6.0E−07 | 2.8E−06 | 5.5E−06 | 1.6 | 1.8 | 3.5 |
| M103205H795-MY466 | 1.7E−07 | 2.6E−07 | 1.4E−06 | 4.6E−06 | 1.7 | 2.8 | 3.9 |
| M103205H795-MY467 | 1.8E−07 | 3.6E−07 | 2.0E−06 | 4.8E−06 | 1.7 | 2.7 | 3.6 |
| M103205H795-MY468 | 2.8E−07 | 4.7E−07 | 2.6E−06 | 6.8E−06 | 1.1 | 2.0 | 3.5 |
| M103205H795-MY469 | 2.0E−07 | 4.3E−07 | 2.4E−06 | 5.9E−06 | 1.5 | 2.4 | 3.5 |
| M103205H795-MY470 | 2.1E−07 | 4.7E−07 | 2.3E−06 | 5.1E−06 | 1.5 | 2.8 | 3.5 |
| M103205H795-MY471 | 2.3E−07 | 4.7E−07 | 2.8E−06 | 5.3E−06 | 1.2 | 2.4 | 3.5 |
| M103205H795-MY472 | 2.5E−07 | 4.9E−07 | 2.5E−06 | 6.2E−06 | 1.3 | 2.4 | 3.3 |
| M103205H795-MY473 | 2.2E−07 | 4.9E−07 | 2.2E−06 | 5.2E−06 | 2.0 | 2.0 | 3.1 |
| M103205H795-MY474 | 1.3E−07 | 3.4E−07 | 2.0E−06 | 4.6E−06 | 1.6 | 2.8 | 3.5 |
| M103205H795-MY475 | 9.0E−07 | 2.1E−07 | 1.1E−06 | 5.0E−06 | 3.2 | 5.1 | 7.4 |
| M103205H795-MY476 | 1.4E−07 | 2.5E−07 | 1.2E−06 | 5.5E−06 | 2.3 | 3.9 | 6.5 |
| M103205H795-MY441 | 3.6E−07 | 6.0E−07 | 2.8E−06 | 8.1E−06 | 0.8 | 1.5 | 2.1 |
| M103205H795-MY442 | 4.6E−07 | 4.2E−07 | 1.8E−06 | 4.7E−06 | 0.7 | 1.2 | 2.5 |
| M103205H795-MY443 | 5.3E−07 | 6.4E−07 | 2.8E−06 | 5.9E−06 | 0.7 | 1.0 | 1.5 |
| M103205H795-MY444 | 1.1E−07 | 1.4E−07 | 7.4E−07 | 5.2E−06 | 2.7 | 4.6 | 8.9 |
| M103205H795-MY445 | 5.6E−07 | 1.1E−06 | 4.2E−06 | 9.5E−06 | 0.6 | 0.5 | 1.2 |
| M103205H795-MY446 | 2.6E−07 | 4.8E−07 | 2.4E−06 | 7.1E−06 | 1.5 | 2.3 | 3.6 |
| M103205H795-MY447 | 9.7E−08 | 9.8E−08 | 4.4E−07 | 4.0E−06 | 3.2 | 5.6 | 11.3 |
| M103205H795-MY448 | 9.1E−07 | 2.1E−08 | 8.4E−06 | 1.3E−06 | 0.3 | 0.7 | 0.6 |
| M103205H795-MY449 | 9.8E−08 | 7.4E−08 | 2.9E−07 | 3.7E−06 | 3.7 | 5.4 | 11.3 |
| M103205H795-MY450 | 1.3E−07 | 1.2E−07 | 4.7E−07 | 4.0E−06 | 2.5 | 4.6 | 7.7 |
| M103205H795-MY451 | 4.1E−07 | 6.4E−07 | 3.0E−06 | 7.1E−06 | 0.9 | 1.2 | 2.5 |
| M103205H795-MY452 | 3.6E−07 | 6.2E−07 | 2.9E−06 | 6.1E−06 | 0.9 | 1.6 | 2.6 |
| M103205H795-MY453 | 7.3E−07 | 1.6E−08 | 6.5E−06 | 1.4E−06 | 0.5 | 0.5 | 0.8 |
| M103205H795-MY454 | 4.1E−07 | 7.6E−07 | 3.1E−06 | 5.9E−06 | 0.8 | 1.8 | 2.2 |
| M103205H795-MY455 | 3.1E−07 | 4.6E−07 | 2.2E−06 | 6.6E−06 | 1.0 | 1.8 | 3.1 |
| M103205H795-MY456 | 1.7E−07 | 2.9E−07 | 1.1E−06 | 5.3E−06 | 1.7 | 3.0 | 5.0 |
| M103205H795-MY457 | 1.2E−07 | 7.3E−08 | 3.3E−07 | 3.6E−06 | 4.0 | 6.1 | 14.2 |
| M103205H795-MY458 | 1.6E−07 | 1.2E−07 | 9.9E−07 | 5.3E−06 | 1.8 | 3.2 | 5.7 |

| | KD fold for cynoFcgRs (SG1 = 1) | | KD fold for humanFcgRs (SG1 = 1) | | | |
|---|---|---|---|---|---|---|
| Heavy chain name | FcgRIIb | FcgRIIIaS | FcgRIIaH | FcgRIIaR | FcgRIIb | FcgRIIIaV |
| M103205H795-SG1 | 1.0 | 1.0 | 1.0 | 1.0 | 1.0 | 1.0 |
| M103205H795-MY265 | 3.1 | 0.2 | 3.3 | 2.5 | 2.1 | 0.2 |
| M103205H795-MY459 | 1.6 | 0.2 | 1.6 | 2.0 | 1.8 | 0.1 |
| M103205H795-MY460 | 2.3 | 0.2 | 2.7 | 2.0 | 1.9 | 0.1 |
| M103205H795-MY461 | 3.8 | 0.2 | 3.6 | 3.2 | 2.7 | 0.2 |
| M103205H795-MY462 | 3.8 | 0.2 | 2.9 | 2.2 | 2.4 | 0.2 |
| M103205H795-MY463 | 3.1 | 0.2 | 3.1 | 2.2 | 2.0 | 0.2 |
| M103205H795-MY464 | 3.6 | 0.2 | 4.1 | 4.2 | 2.9 | 0.2 |
| M103205H795-MY465 | 2.5 | 0.2 | 2.8 | 1.8 | 1.6 | 0.1 |
| M103205H795-MY466 | 3.5 | 0.2 | 4.1 | 4.2 | 3.3 | 0.2 |
| M103205H795-MY467 | 3.5 | 0.2 | 3.8 | 3.1 | 2.3 | 0.2 |
| M103205H795-MY468 | 2.8 | 0.2 | 2.5 | 2.3 | 1.8 | 0.1 |
| M103205H795-MY469 | 3.0 | 0.2 | 3.5 | 2.6 | 1.9 | 0.1 |
| M103205H795-MY470 | 3.3 | 0.2 | 3.3 | 2.3 | 2.0 | 0.2 |
| M103205H795-MY471 | 2.6 | 0.2 | 3.0 | 2.3 | 1.6 | 0.2 |
| M103205H795-MY472 | 2.7 | 0.2 | 2.8 | 2.2 | 1.8 | 0.1 |
| M103205H795-MY473 | 3.1 | 0.2 | 3.1 | 2.2 | 2.1 | 0.2 |
| M103205H795-MY474 | 3.6 | 0.2 | 4.1 | 3.2 | 2.9 | 0.2 |
| M103205H795-MY475 | 6.7 | 0.2 | 7.7 | 5.2 | 4.2 | 0.2 |
| M103205H795-MY476 | 4.6 | 0.2 | 4.9 | 4.4 | 3.8 | 0.1 |
| M103205H795-MY441 | 2.0 | 0.2 | 1.9 | 1.8 | 1.6 | 0.1 |

TABLE 22-continued

| Kinetic analysis of variants derived from. MY265 | | | | | | |
|---|---|---|---|---|---|---|
| M103205H795-MY442 | 1.0 | 0.2 | 1.5 | 2.6 | 2.6 | 0.2 |
| M103205H795-MY443 | 1.5 | 0.2 | 1.5 | 1.7 | 1.6 | 0.1 |
| M103205H795-MY444 | 6.0 | 0.2 | 6.5 | 7.5 | 6.2 | 0.2 |
| M103205H795-MY445 | 1.3 | 0.2 | 1.2 | 1.0 | 1.1 | 0.1 |
| M103205H795-MY446 | 2.5 | 0.2 | 2.7 | 2.3 | 1.9 | 0.1 |
| M103205H795-MY447 | 7.8 | 0.3 | 7.1 | 11.2 | 10.5 | 0.2 |
| M103205H795-MY448 | 0.8 | 0.2 | 0.7 | 0.5 | 0.5 | 0.1 |
| M103205H795-MY449 | 7.8 | 0.4 | 7.0 | 14.9 | 15.9 | 0.2 |
| M103205H795-MY450 | 6.4 | 0.3 | 5.3 | 9.2 | 9.8 | 0.2 |
| M103205H795-MY451 | 1.8 | 0.2 | 1.7 | 1.7 | 1.5 | 0.1 |
| M103205H795-MY452 | 2.0 | 0.2 | 2.9 | 1.8 | 1.6 | 0.1 |
| M103205H795-MY453 | 0.9 | 0.2 | 0.9 | 0.7 | 0.7 | 0.2 |
| M103205H795-MY454 | 1.8 | 0.2 | 1.7 | 1.4 | 1.5 | 0.2 |
| M103205H795-MY455 | 2.0 | 0.2 | 2.7 | 2.4 | 2.1 | 0.1 |
| M103205H795-MY456 | 3.5 | 0.2 | 4.1 | 3.8 | 4.2 | 0.2 |
| M103205H795-MY457 | 9.0 | 0.3 | 5.6 | 15.1 | 13.9 | 0.2 |
| M103205H795-MY458 | 4.2 | 0.2 | 4.3 | 4.3 | 4.6 | 0.2 |

Although all the variants showed decreased affinity to both human and cynoFcγRIIb compared to the parent MY201, MY265, which is produced by substituting Asn with Thr at position 236 of MY201, maintained enhanced binding by 2.1-fold for human FcγRIIb and 3.1-fold for cynoFcγRIIb, respectively, compared to SG1. MY265 also maintained reduced binding to both human and cynoFcγRIIIa. Although affinity to human FcγRIIaH and FcγRIIaR was enhanced by more than 2.5-fold compared to SG1, G236T is the second favorable substitution at position 236.

In order to improve the selectivity and affinity of MY265 to human FcγRIIb, comprehensive mutagenesis study into position 231 and 232 was performed. Specifically position 231 and 232 of M103205H795-MY265 were substituted with 18 amino acid residues excluding the original amino acid and Cys. The resultant variants were expressed using M103202L889-SK1 as light chain and their affinity to human and cynoFcγRs were evaluated (Table 22). Values of KD fold were calculated by dividing the KD value of SG1 by the KD value of the variant for each FcγR.

With respect to affinity to FcγRIIb, the addition of A231T, A231M, A231V, A231G, A231F, A231I, A231L, A231, A231W, P232V, P232Y, P232F, P232M, P2321, P232W, P232L increased binding to both human and cynoFcγRIIb compared to parent MY265. Above all, addition of A231T and A231G reduced human FcγRIIaR binding compared to MY265.

The combination of the substitutions which was not evaluated in the preceding examples were evaluated. The substitutions tested and revealed to be promising were introduced into M103205H795-SG1 in combination. The resultant variants were expressed using M103202L889-SK1 as light chain and their affinity to human and cynoFcγRs were evaluated. Tables 23A and 23B show the result and the KD values in cells filled in gray were calculated using [Equation 2]since their affinity was too weak to be correctly determined by kinetic analysis. Values of KD fold were calculated by dividing the KD value of SG1 by the KD value of the variant for each FcγR. The values for MY209 which was selected as a promising variants in Table 19 were shown again for comparison.

Among the variants tested, only MY213 showed higher binding affinity to both human and cynoFcγRIIb compared to MY209. However, the affinities of MY213 to human FcγRIIaH and human FcγRIIaR are higher than those of MY209.

TABLE 23A

| Kinetic analysis of other combinations | | | | | | |
|---|---|---|---|---|---|---|
| | | KD (M) for cynoFcgRs | | | | |
| Heavy chain name | Substitutions | FcgRIIa1 | FcgRIIa2 | FcgRIIa3 | FcgRIIb | FcgRIIIa5 |
| M103205H795-SG1 | — | 3.2E−06 | 5.1E−06 | 1.7E−05 | 1.8E−06 | 3.6E−07 |
| M103205H795-MY209 | G236N/H268D/Q295L/K326T/A330K | 6.3E−07 | 6.9E−07 | 1.9E−06 | 1.9E−07 | 2.2E−06 |
| M103205H795-MY142 | G236E/H268E/P396M | 4.1E−06 | 4.9E−06 | 2.5E−05 | 1.8E−06 | 1.4E−07 |
| M103205H795-MY143 | G236S/H268E/P396M | 1.1E−06 | 1.3E−06 | 2.9E−06 | 4.6E−07 | 2.8E−07 |
| M103205H795-MY269 | G236M/H268D/A330K/P396K | 2.3E−06 | 2.6E−06 | 6.4E−06 | 6.5E−07 | 2.2E−07 |
| M103205H795-MY270 | G236H/H268D/A330K/P396K | 1.8E−06 | 2.1E−06 | 2.6E−06 | 5.3E−07 | 1.1E−06 |
| M103205H795-MY271 | G236V/H268D/A330K/P396K | 7.6E−07 | 7.0E−07 | 3.1E−06 | 1.9E−07 | 837E−07 |
| M103205H795-MY272 | G236Q/H268D/A330K/P396K | 1.7E−06 | 1.9E−06 | 6.2E−06 | 4.3E−07 | 2.9E−07 |
| M103205H795-MY273 | G236L/H268D/A330K/P396K | 3.7E−06 | 3.5E−06 | 1.1E−05 | 1.2E−06 | 1.7E−06 |
| M103205H795-MY274 | G236T/H268D/A330K/P396K | 8.8E−07 | 8.0E−07 | 2.0E−06 | 2.3E−07 | 6.2E−07 |
| M103205H795-MY276 | G236I/H268D/A330K/P396K | 1.2E−06 | 1.1E−06 | 4.5E−06 | 3.1E−07 | 1.2E−06 |
| M103205H795-MY278 | G236M/H268D/Q295L/A330K | 3.0E−06 | 3.6E−06 | 1.0E−05 | 1.1E−06 | 7.4E−07 |
| M103205H795-MY279 | G236H/H268D/Q295L/A330K | 2.8E−06 | 3.3E−06 | 4.7E−06 | 9.1E−07 | 2.4E−06 |
| M103205H795-MY280 | G236V/H268D/Q295L/A330K | 1.0E−06 | 1.2E−06 | 4.6E−06 | 3.3E−07 | 1.8E−06 |
| M103205H795-MY281 | G236Q/H268D/Q295L/A330K | 1.9E−06 | 2.5E−06 | 9.1E−06 | 6.2E−07 | 7.4E−07 |
| M103205H795-MY285 | G236I/H268D/Q295L/A330K | 1.6E−06 | 1.7E−06 | 6.8E−06 | 5.8E−07 | 2.9E−06 |
| M103205H795-MY213 | G236N/H268D/A330K/P396K | 5.3E−07 | 5.2E−07 | 1.3E−06 | 1.6E−07 | 1.9E−06 |
| M103205H795-MY242 | G238I/H268D/A330K/P396K | 4.5E−06 | 4.2E−06 | 5.9E−06 | 1.1E−06 | 5.3E−07 |
| M103205H795-MY219 | G237Y/H268D/A330K | 3.5E−06 | 4.0E−06 | 5.5E−06 | 1.3E−06 | 6.2E−06 |

TABLE 23A-continued

Kinetic analysis of other combinations

| | | | | | | |
|---|---|---|---|---|---|---|
| M103205H795-MY227 | G237Y/H268D/A330K/P396K | 1.9E−06 | 2.5E−06 | 2.5E−06 | 5.1E−07 | 3.9E−06 |
| M103205H795-MY228 | G237Y/H268D/Q295L/A330K | 3.0E−06 | 3.1E−06 | 3.6E−06 | 1.1E−06 | 9.7E−06 |
| M103205H795-MY229 | G237Y/H268D/Q295L/A330K/P396K | 1.6E−06 | 2.2E−06 | 1.9E−06 | 4.7E−07 | 4.2E−06 |
| M103205H795-MY292 | G237Y/H268D/Q295L/A330K/P396M | 1.5E−06 | 2.6E−06 | 2.2E−06 | 4.5E−07 | 4.0E−06 |
| M103205H795-MY293 | G237Y/H268E/Q295L/A330K/P396K | 2.8E−06 | 3.3E−06 | 3.9E−06 | 8.6E−07 | 4.2E−06 |
| M103205H795-MY308 | G236T/H268E/A330K | 3.3E−06 | 4.6E−06 | 1.1E−05 | 1.5E−06 | 2.3E−06 |
| M103205H795-MY309 | G236T/H268E/A330K/P396M | 2.5E−06 | 2.5E−06 | 7.0E−06 | 7.1E−07 | 1.2E−06 |
| M103205H795-MY310 | G236T/H268E/K326T/A330K | 3.0E−06 | 2.9E−06 | 7.2E−06 | 9.5E−07 | 1.8E−06 |
| M103205H795-MY311 | G236T/H268E/Q295L/A330K | 2.3E−06 | 3.4E−06 | 8.6E−06 | 7.8E−07 | 2.4E−06 |
| M103205H795-MY312 | G236T/H268E/K326T/A330K/P396M | 1.4E−06 | 1.5E−06 | 3.7E−06 | 4.0E−07 | 6.5E−07 |
| M103205H795-MY316 | G236L/H268E/Q295L/A330K/P396K | 5.1E−06 | 8.6E−06 | 2.2E−05 | 2.0E−06 | 2.4E−06 |
| M103205H795-MY318 | G236L/H268E/K326T/A330K/P396M | 7.9E−06 | 7.7E−06 | 3.2E−05 | 2.2E−06 | 1.5E−06 |
| M103205H795-MY321 | G236H/H268D/A330K/P396M | 2.3E−06 | 2.2E−06 | 2.9E−06 | 6.4E−07 | 1.1E−06 |
| M103205H795-MY325 | G236O/H268D/A330K | 4.0E−06 | 4.4E−06 | 5.8E−06 | 9.8E−07 | 4.0E−06 |
| M103205H795-MY327 | G236O/H268E/Q295L/A330K | 3.4E−06 | 4.8E−06 | 5.3E−06 | 1.0E−06 | 4.5E−06 |
| M103205H795-MY329 | G236O/H268D/Q295L/A330K | 1.9E−06 | 3.1E−06 | 3.7E−06 | 5.9E−07 | 2.3E−06 |

| | KD (M) for humanFcgRs | | | | KD fold for cynoFcgRs (SG1 = 1) | | |
|---|---|---|---|---|---|---|---|
| Heavy chain name | FcgRIIaH | FcgRIIaR | FcgRIIb | FcgRIIIaV | FcgRIIa1 | FcgRIIa2 | FcgRIIa3 |
| M103205H795-SG1 | 6.9E−07 | 1.1E−06 | 4.6E−06 | 8.1E−07 | 1.0 | 1.0 | 1.0 |
| M103205H795-MY209 | 5.7E−07 | 8.8E−07 | 5.0E−06 | 1.4E−05 | 5.1 | 7.4 | 8.9 |
| M103205H795-MY142 | 1.9E−07 | 1.7E−07 | 9.3E−07 | 5.8E−07 | 0.8 | 1.0 | 0.7 |
| M103205H795-MY143 | 3.7E−08 | 8.3E−08 | 6.8E−07 | 1.6E−06 | 2.9 | 3.9 | 5.9 |
| M103205H795-MY269 | 2.5E−07 | 7.2E−07 | 2.1E−06 | 1.1E−06 | 1.4 | 2.0 | 2.7 |
| M103205H795-MY270 | 7.3E−08 | 3.7E−07 | 2.6E−06 | 3.7E−06 | 1.8 | 2.4 | 6.5 |
| M103205H795-MY271 | 4.4E−08 | 2.3E−07 | 2.1E−06 | 2.3E−06 | 4.2 | 7.3 | 5.5 |
| M103205H795-MY272 | 9.2E−08 | 2.5E−07 | 1.2E−06 | 8.7E−07 | 1.9 | 2.7 | 2.7 |
| M103205H795-MY273 | 5.1E−07 | 1.0E−06 | 5.0E−06 | 9.7E−06 | 0.9 | 1.5 | 1.5 |
| M103205H795-MY274 | 8.1E−06 | 1.7E−07 | 9.5E−07 | 2.5E−06 | 3.6 | 6.4 | 8.5 |
| M103205H795-MY276 | 5.3E−08 | 2.5E−07 | 2.4E−06 | 5.7E−06 | 2.9 | 4.6 | 3.8 |
| M103205H795-MY278 | 5.3E−07 | 1.5E−06 | 4.4E−06 | 3.4E−06 | 1.1 | 1.4 | 1.7 |
| M103205H795-MY279 | 1.4E−07 | 7.2E−07 | 4.6E−06 | 7.0E−06 | 1.1 | 1.5 | 3.6 |
| M103205H795-MY280 | 8.1E−08 | 4.5E−07 | 2.9E−06 | 4.4E−06 | 3.2 | 4.3 | 3.7 |
| M103205H795-MY281 | 1.3E−07 | 3.9E−07 | 1.8E−06 | 2.1E−06 | 1.7 | 2.0 | 1.9 |
| M103205H795-MY285 | 1.1E−07 | 5.6E−07 | 3.9E−06 | 1.6E−05 | 2.0 | 3.0 | 2.5 |
| M103205H795-MY213 | 3.5E−07 | 6.9E−07 | 3.6E−07 | 1.1E−05 | 6.0 | 9.8 | 13.1 |
| M103205H795-MY242 | 8.2E−07 | 6.3E−07 | 1.9E−06 | 3.2E−06 | 0.7 | 1.2 | 2.9 |
| M103205H795-MY219 | 2.8E−06 | 1.6E−07 | 3.4E−07 | 9.1E−05 | 0.9 | 1.3 | 3.1 |
| M103205H795-MY227 | 1.3E−06 | 6.2E−08 | 1.3E−07 | 1.8E−05 | 1.7 | 2.0 | 6.8 |
| M103205H795-MY228 | 2.2E−06 | 1.6E−07 | 3.0E−07 | 1.4E−04 | 1.1 | 1.6 | 4.7 |
| M103205H795-MY229 | 9.8E−07 | 8.1E−08 | 1.5E−07 | 3.7E−05 | 2.0 | 2.3 | 8.9 |
| M103205H795-MY292 | 9.5E−07 | 7.6E−08 | 1.4E−07 | 2.8E−05 | 2.1 | 2.0 | 7.7 |
| M103205H795-MY293 | 1.3E−06 | 7.3E−08 | 1.5E−07 | 3.9E−05 | 1.1 | 1.5 | 4.4 |
| M103205H795-MY308 | 4.5E−07 | 8.6E−07 | 4.1E−06 | 8.8E−06 | 1.0 | 1.1 | 1.5 |
| M103205H795-MY309 | 1.4E−07 | 2.6E−07 | 1.6E−06 | 4.3E−06 | 1.3 | 2.0 | 2.4 |
| M103205H795-MY310 | 4.0E−07 | 5.5E−07 | 2.9E−06 | 6.9E−06 | 1.1 | 1.8 | 2.4 |
| M103205H795-MY311 | 2.0E−07 | 4.5E−07 | 2.1E−06 | 7.1E−06 | 1.4 | 1.5 | 2.0 |
| M103205H795-MY312 | 1.1E−07 | 1.7E−07 | 1.1E−06 | 2.8E−06 | 2.3 | 3.4 | 4.6 |
| M103205H795-MY316 | 4.4E−07 | 1.1E−06 | 4.0E−06 | 1.7E−05 | 0.6 | 0.6 | 0.8 |
| M103205H795-MY318 | 1.1E−06 | 1.3E−06 | 4.8E−06 | 8.7E−06 | 0.4 | 0.7 | 0.5 |
| M103205H795-MY321 | 7.1E−08 | 3.8E−07 | 2.6E−06 | 3.4E−06 | 1.4 | 2.3 | 5.9 |
| M103205H795-MY325 | 5.1E−07 | 3.0E−07 | 2.6E−07 | 8.1E−06 | 0.8 | 1.2 | 2.9 |
| M103205H795-MY327 | 3.5E−07 | 2.0E−07 | 1.7E−07 | 9.9E−06 | 0.9 | 1.1 | 3.2 |
| M103205H795-MY329 | 2.7E−07 | 2.1E−07 | 1.6E−07 | 6.4E−06 | 1.7 | 1.6 | 4.6 |

| | KD fold for cynoFcgRs (SG1 = 1) | | KD fold for humanFcgRs (SG1 = 1) | | | |
|---|---|---|---|---|---|---|
| Heavy chain name | FcgRIIb | FcgRIIIa5 | FcgRIIaH | FcgRIIaR | FcgRIIb | FcgRIIIaV |
| M103205H795-SG1 | 1.0 | 1.00 | 1.0 | 1.0 | 1.0 | 1.00 |
| M103205H795-MY209 | 9.5 | 0.16 | 1.2 | 1.3 | 9.2 | 0.06 |
| M103205H795-MY142 | 1.0 | 2.57 | 3.6 | 6.5 | 4.8 | 1.40 |
| M103205H795-MY143 | 3.9 | 1.29 | 18.6 | 13.1 | 6.8 | 0.51 |
| M103205H795-MY269 | 2.8 | 1.64 | 2.8 | 1.5 | 2.2 | 0.74 |
| M103205H795-MY270 | 3.6 | 0.33 | 9.5 | 3.0 | 1.8 | 0.22 |
| M103205H795-MY271 | 9.5 | 0.41 | 15.7 | 4.0 | 2.2 | 0.35 |
| M103205H795-MY272 | 4.2 | 1.24 | 7.5 | 4.4 | 3.8 | 0.93 |
| M103205H795-MY273 | 1.5 | 0.21 | 1.4 | 1.1 | 0.9 | 0.08 |
| M103205H795-MY274 | 7.8 | 0.58 | 8.5 | 6.5 | 4.8 | 0.32 |
| M103205H795-MY276 | 5.6 | 0.30 | 13.0 | 4.4 | 1.9 | 0.14 |
| M103205H795-MY278 | 1.6 | 0.49 | 1.3 | 0.7 | 1.0 | 0.24 |
| M103205H795-MY279 | 2.0 | 0.15 | 4.9 | 1.5 | 1.0 | 0.12 |
| M103205H795-MY280 | 5.5 | 0.20 | 8.5 | 2.4 | 1.6 | 0.18 |
| M103205H795-MY281 | 2.9 | 0.49 | 5.3 | 2.8 | 2.6 | 0.39 |

TABLE 23A-continued

Kinetic analysis of other combinations

| | | | | | | |
|---|---|---|---|---|---|---|
| M103205H795-MY285 | 3.1 | 0.12 | 6.3 | 2.0 | 1.2 | 0.05 |
| M103205H795-MY213 | 11.3 | 0.19 | 2.0 | 1.6 | 12.8 | 0.07 |
| M103205H795-MY242 | 1.6 | 0.58 | 0.8 | 1.7 | 2.4 | 0.25 |
| M103205H795-MY219 | 1.4 | 0.06 | 0.2 | 6.9 | 13.5 | 0.01 |
| M103205H795-MY227 | 3.5 | 0.09 | 0.5 | 17.7 | 35.4 | 0.04 |
| M103205H795-MY228 | 1.6 | 0.04 | 0.3 | 6.9 | 15.3 | 0.01 |
| M103205H795-MY229 | 3.8 | 0.09 | 0.7 | 13.6 | 30.7 | 0.02 |
| M103205H795-MY292 | 4.0 | 0.09 | 0.7 | 14.5 | 32.9 | 0.03 |
| M103205H795-MY293 | 2.1 | 0.09 | 0.5 | 15.1 | 30.7 | 0.02 |
| M103205H795-MY308 | 1.2 | 0.16 | 1.5 | 1.3 | 1.1 | 0.09 |
| M103205H795-MY309 | 2.5 | 0.30 | 4.9 | 4.2 | 2.9 | 0.19 |
| M103205H795-MY310 | 1.9 | 0.20 | 1.7 | 2.0 | 1.6 | 0.12 |
| M103205H795-MY311 | 2.3 | 0.15 | 3.5 | 2.4 | 2.2 | 0.11 |
| M103205H795-MY312 | 4.5 | 0.55 | 6.3 | 6.5 | 4.2 | 0.29 |
| M103205H795-MY316 | 0.9 | 0.15 | 1.6 | 1.0 | 1.2 | 0.05 |
| M103205H795-MY318 | 0.8 | 0.24 | 0.6 | 0.8 | 1.0 | 0.09 |
| M103205H795-MY321 | 2.8 | 0.33 | 9.7 | 2.9 | 1.8 | 0.24 |
| M103205H795-MY325 | 1.8 | 0.09 | 1.4 | 3.7 | 17.7 | 0.10 |
| M103205H795-MY327 | 1.8 | 0.08 | 2.0 | 5.5 | 27.1 | 0.08 |
| M103205H795-MY329 | 3.1 | 0.18 | 2.6 | 5.2 | 28.8 | 0.13 |

TABLE 23B

Kinetic analysis of other combinations

| | | KD (M) for cynoFcgRs | | | | |
|---|---|---|---|---|---|---|
| Heavy chain name | Substitutions | FcgRIIa1 | FcgRIIa2 | FcgRIIa3 | FcgRIIb | FcgRIIIaS |
| M103205H795-SG1 | — | 3.2E−06 | 5.1E−06 | 1.7E−05 | 1.8E−06 | 3.6E−07 |
| M103205H795-MY209 | G236N/H268D/Q295L/K326T/A330K | 6.3E−07 | 6.9E−07 | 1.9E−06 | 1.9E−07 | 2.2E−06 |
| M103205H795-MY340 | G236N/H268D/Q295L/A330K/P396K | 4.3E−06 | 4.9E−06 | 2.3E−05 | 1.1E−06 | 2.3E−06 |
| M103205H795-MY341 | G236N/H268D/Q295L/K326T/A330K/P396K | 2.6E−06 | 2.9E−06 | 8.8E−06 | 6.0E−07 | 9.4E−07 |
| M103205H795-MY342 | G236N/H268D/Q295L/A330K/P396M | 5.1E−06 | 8.5E−06 | 5.1E−05 | 1.3E−06 | 2.6E−06 |
| M103205H795-MY283 | G236T/H268D/Q295L/A330K | 1.4E−06 | 1.6E−06 | 4.4E−06 | 4.2E−07 | 2.2E−06 |
| M103205H795-MY339 | G236L/H268D/K326T/A330K/P396K | 3.4E−06 | 3.0E−06 | 9.8E−06 | 7.3E−07 | 7.6E−07 |
| M103205H795-MY380 | G236N/H268E/A330K/P396K | 9.3E−07 | 1.0E−06 | 3.3E−06 | 2.9E−07 | 2.8E−06 |
| M103205H795-MY388 | G236L/H268D/Q295L/K326T/A330K | 5.2E−06 | 5.6E−06 | 1.6E−05 | 1.6E−06 | 2.5E−06 |
| M103205H795-MY388 | G236T/S239I/H268D/A330K | 2.2E−06 | 1.7E−06 | 1.3E−06 | 7.6E−07 | 1.6E−06 |
| M103205H795-MY389 | G236T/S239L/H268D/A330K | 2.0E−06 | 1.6E−06 | 1.4E−06 | 7.0E−07 | 1.5E−06 |
| M103205H795-MY400 | G236T/H268D/A330K/P332E | 1.8E−06 | 2.2E−06 | 3.8E−06 | 6.3E−07 | 2.4E−06 |
| M103205H795-MY392 | G236T/H268D/S298L/A330K | 3.0E−07 | 2.3E−06 | 3.9E−06 | 7.0E−07 | 4.0E−06 |
| M103205H795-MY387 | G236T/S239V/H268D/A330K | 2.3E−06 | 1.9E−06 | 1.4E−06 | 8.3E−07 | 2.5E−06 |
| M103205H795-MY514 | G236T/S239V/H268D/S258L/A330K | 2.6E−07 | 1.6E−06 | 1.5E−06 | 7.6E−07 | 4.4E−06 |
| M103205H795-MY515 | G236T/H268D/Q295L/S298L/A330K | 1.4E−07 | 1.6E−06 | 2.9E−06 | 3.9E−07 | 3.8E−06 |
| M103205H795-MY516 | G236T/S239V/H268D/Q235L/S298L/A330K | 1.5E−07 | 1.3E−06 | 7.9E−07 | 4.5E−07 | 3.0E−06 |
| M103205H795-MY520 | P232D/G236T/S239V/H268D/Q295L/A330K | 2.5E−06 | 2.3E−06 | 2.1E−06 | 9.6E−07 | 2.0E−06 |
| M103205H795-MY521 | P232D/G236T/H268D/Q235L/A330K | 2.5E−06 | 3.3E−06 | 4.4E−06 | 8.0E−07 | 2.2E−06 |
| M103205H795-MY522 | A231G/G236T/S239V/H268D/A330K | 1.7E−06 | 1.2E−06 | 9.3E−07 | 5.3E−07 | 1.9E−06 |
| M103205H795-MY523 | A231G/G236T/S239V/H268D/Q295L/A330K | 1.4E−06 | 1.3E−06 | 1.1E−06 | 4.8E−07 | 2.1E−06 |
| M103205H795-MY524 | A231G/G236T/H268D/Q295L/A330K | 1.0E−06 | 1.1E−06 | 2.7E−06 | 3.1E−07 | 2.0E−06 |
| M103205H795-MY525 | A231T/G236T/S239V/H268D/A330K | 1.6E−06 | 1.1E−06 | 1.1E−06 | 5.1E−07 | 1.4E−06 |
| M103205H795-MY526 | A231T/G236T/S239V/H268D/Q295L/A330K | 1.3E−06 | 1.2E−06 | 1.3E−06 | 4.6E−07 | 1.6E−06 |
| M103205H795-MY527 | A231T/G236T/H268D/Q295L/A330K | 1.1E−06 | 1.3E−06 | 3.4E−06 | 3.4E−07 | 1.5E−06 |
| M103205H795-MY528 | L234W/G236T/H268D/A330K | 1.4E−06 | 1.5E−06 | 3.2E−06 | 4.1E−07 | 2.0E−06 |
| M103205H795-MY529 | L234W/G236T/H268D/Q295L/A330K | 1.0E−06 | 1.4E−06 | 3.2E−06 | 3.0E−07 | 2.2E−06 |
| M103205H795-MY530 | G236T/H268D/K326T/A330K | 1.3E−06 | 1.1E−06 | 2.5E−06 | 3.2E−07 | 8.6E−07 |
| M103205H795-MY531 | L234W/G236T/H268D/K326T/A330K | 1.1E−06 | 9.2E−07 | 2.2E−06 | 2.7E−07 | 1.0E−06 |
| M103205H795-MY532 | L234W/G236T/S239V/H268D/A330K | 7.7E−07 | 6.0E−07 | 7.4E−07 | 2.3E−07 | 8.6E−07 |
| M103205H795-MY533 | G234W/G236T/S239V/H268D/Q295L/A330K | 8.0E−07 | 7.3E−07 | 1.2E−06 | 2.5E−07 | 1.1E−06 |
| M103205H795-MY534 | A236T/S239V/H268D/Q295L/A330K | 1.3E−06 | 1.3E−06 | 1.2E−06 | 4.2E−07 | 1.7E−06 |
| M103205H795-MY535 | A231G/L234W/G236T/H268D/A330K | 1.6E−06 | 1.4E−06 | 3.0E−06 | 4.1E−07 | 2.1E−06 |
| M103205H795-MY536 | A231G/L234W/G236T/S239V/H268D/A330K | 1.2E−06 | 1.1E−06 | 9.8E−07 | 4.0E−07 | 1.6E−06 |
| M103205H795-MY537 | A231G/L234W/G236T/S239V/H268D/Q295L/A330K | 1.2E−06 | 1.1E−06 | 1.4E−06 | 3.2E−07 | 1.5E−06 |
| M103205H795-MY538 | A231G/L234W/G236T/H268D/Q295L/A330K | 9.6E−07 | 1.1E−06 | 3.0E−06 | 2.8E−07 | 2.4E−06 |

| | KD (M) for humanFcgRs | | | | KD fold for cynoFcgRs (SG1 = 1) | | |
|---|---|---|---|---|---|---|---|
| Heavy chain name | FcgRIIaH | FcgRIIaR | FcgRIIb | FcgRIIIaV | FcgRIIa1 | FcgRIIa2 | FcgRIIa3 |
| M103205H795-SG1 | 6.7E−07 | 1.1E−06 | 4.6E−06 | 8.1E−07 | 1.0 | 1.0 | 1.0 |
| M103205H795-MY209 | 5.7E−07 | 8.8E−07 | 5.0E−07 | 1.4E−05 | 5.1 | 7.4 | 8.9 |
| M103205H795-MY340 | 3.1E−07 | 8.3E−07 | 3.3E−06 | 1.7E−05 | 0.7 | 1.0 | 0.7 |
| M103205H795-MY341 | 2.6E−07 | 4.2E−07 | 1.8E−06 | 7.0E−06 | 1.2 | 1.8 | 1.9 |

TABLE 23B-continued

Kinetic analysis of other combinations

| | | | | | | | |
|---|---|---|---|---|---|---|---|
| M103205H795-MY342 | 3.7E−07 | 1.0E−06 | 3.9E−06 | 2.5E−05 | 0.6 | 0.6 | 0.3 |
| M103205H795-MY283 | 1.4E−07 | 3.5E−07 | 1.8E−06 | 5.7E−06 | 2.3 | 3.2 | 3.9 |
| M103205H795-MY339 | 4.1E−07 | 6.3E−07 | 2.8E−06 | 5.6E−06 | 0.9 | 1.7 | 1.7 |
| M103205H795-MY380 | 4.5E−07 | 8.5E−07 | 4.8E−07 | 1.0E−09 | 3.4 | 5.1 | 5.2 |
| M103205H795-MY388 | 8.1E−07 | 1.7E−06 | 4.6E−06 | 2.4E−09 | 0.6 | 0.9 | 1.1 |
| M103205H795-MY388 | 3.3E−07 | 2.3E−07 | 1.5E−06 | 4.3E−06 | 1.9 | 3.0 | 13.1 |
| M103205H795-MY389 | 2.7E−07 | 1.9E−07 | 1.1E−06 | 3.5E−06 | 1.6 | 3.2 | 12.1 |
| M103205H795-MY400 | 4.2E−07 | 7.4E−07 | 2.5E−06 | 7.8E−06 | 1.8 | 2.3 | 4.5 |
| M103205H795-MY392 | 4.3E−07 | 4.1E−07 | 1.7E−06 | 9.3E−06 | 10.7 | 2.2 | 4.4 |
| M103205H795-MY387 | 2.4E−07 | 2.0E−07 | 1.6E−06 | 4.7E−06 | 1.4 | 2.7 | 12.1 |
| M103205H795-MY514 | 3.5E−07 | 1.6E−07 | 6.9E−07 | 8.8E−06 | 12.3 | 3.2 | 11.3 |
| M103205H795-MY515 | 2.2E−07 | 2.6E−07 | 1.2E−06 | 9.0E−06 | 22.9 | 3.2 | 5.9 |
| M103205H795-MY516 | 2.2E−07 | 8.5E−08 | 5.1E−07 | 6.7E−06 | 21.3 | 3.9 | 21.5 |
| M103205H795-MY520 | 4.9E−07 | 3.4E−07 | 1.4E−06 | 3.5E−06 | 1.3 | 2.2 | 8.1 |
| M103205H795-MY521 | 2.9E−07 | 3.0E−07 | 1.5E−06 | 5.1E−06 | 1.3 | 1.5 | 3.9 |
| M103205H795-MY522 | 2.4E−07 | 1.7E−07 | 1.1E−06 | 5.7E−06 | 1.9 | 4.3 | 18.3 |
| M103205H795-MY523 | 1.9E−07 | 2.1E−07 | 1.1E−06 | 5.5E−06 | 2.3 | 3.9 | 15.5 |
| M103205H795-MY524 | 1.1E−07 | 2.8E−07 | 1.0E−06 | 4.5E−06 | 3.2 | 4.6 | 6.3 |
| M103205H795-MY525 | 2.1E−07 | 1.6E−07 | 1.2E−06 | 4.3E−06 | 2.0 | 4.6 | 15.5 |
| M103205H795-MY526 | 1.7E−07 | 2.1E−07 | 1.2E−06 | 4.3E−06 | 2.5 | 4.3 | 13.1 |
| M103205H795-MY527 | 1.1E−07 | 2.9E−07 | 1.4E−06 | 4.5E−06 | 2.9 | 3.9 | 5.0 |
| M103205H795-MY528 | 3.5E−07 | 5.6E−07 | 2.2E−06 | 4.2E−06 | 2.3 | 3.4 | 5.3 |
| M103205H795-MY529 | 2.3E−07 | 5.3E−07 | 1.4E−06 | 4.0E−06 | 3.2 | 3.6 | 5.3 |
| M103205H795-MY530 | 1.7E−07 | 2.7E−07 | 1.6E−06 | 3.6E−06 | 2.5 | 4.6 | 6.8 |
| M103205H795-MY531 | 2.9E−07 | 4.1E−07 | 1.5E−06 | 2.9E−06 | 2.9 | 5.5 | 7.7 |
| M103205H795-MY532 | 2.1E−07 | 1.9E−07 | 8.3E−07 | 1.7E−06 | 4.2 | 8.5 | 23.0 |
| M103205H795-MY533 | 2.1E−07 | 2.0E−07 | 9.5E−07 | 1.8E−06 | 4.0 | 7.0 | 14.2 |
| M103205H795-MY534 | 1.7E−07 | 1.9E−07 | 1.2E−06 | 4.3E−06 | 2.5 | 3.5 | 14.2 |
| M103205H795-MY535 | 3.9E−07 | 6.4E−07 | 1.9E−06 | 5.2E−06 | 2.1 | 3.6 | 5.7 |
| M103205H795-MY536 | 2.9E−07 | 2.2E−07 | 9.9E−07 | 2.7E−06 | 2.7 | 4.6 | 17.3 |
| M103205H795-MY537 | 2.8E−07 | 3.7E−07 | 1.0E−06 | 3.3E−06 | 2.7 | 4.6 | 12.1 |
| M103205H795-MY538 | 2.5E−07 | 6.2E−07 | 1.3E−06 | 5.7E−06 | 3.3 | 4.6 | 5.7 |

| Heavy chain name | KD fold for cynoFcgRs (SG1 = 1) | | KD fold for humanFcgRs (SG1 = 1) | | | |
|---|---|---|---|---|---|---|
| | FcgRIIb | FcgRIIIaS | FcgRIIaH | FcgRIIaR | FcgRIIb | FcgRIIIaV |
| M103205H795-SG1 | 1.0 | 1.00 | 1.0 | 1.0 | 1.0 | 1.00 |
| M103205H795-MY209 | 9.5 | 0.16 | 1.2 | 1.3 | 9.2 | 0.06 |
| M103205H795-MY340 | 1.6 | 0.16 | 2.2 | 1.3 | 1.4 | 0.05 |
| M103205H795-MY341 | 3.0 | 0.38 | 2.7 | 2.6 | 2.6 | 0.12 |
| M103205H795-MY342 | 1.4 | 0.14 | 1.9 | 1.1 | 1.2 | 0.09 |
| M103205H795-MY283 | 4.3 | 0.16 | 4.9 | 3.1 | 2.6 | 0.14 |
| M103205H795-MY339 | 2.4 | 0.47 | 1.7 | 1.7 | 1.6 | 0.14 |
| M103205H795-MY380 | 6.2 | 0.13 | 1.5 | 1.3 | 9.6 | 0.08 |
| M103205H795-MY388 | 1.1 | 0.14 | 0.9 | 0.6 | 1.0 | 0.03 |
| M103205H795-MY388 | 2.4 | 0.23 | 2.1 | 4.8 | 3.1 | 0.19 |
| M103205H795-MY389 | 2.6 | 0.24 | 2.6 | 5.8 | 4.2 | 0.23 |
| M103205H795-MY400 | 2.9 | 0.15 | 1.6 | 1.5 | 1.8 | 0.10 |
| M103205H795-MY392 | 2.6 | 0.09 | 1.6 | 2.7 | 2.7 | 0.09 |
| M103205H795-MY387 | 2.7 | 0.14 | 2.9 | 5.5 | 2.9 | 0.17 |
| M103205H795-MY514 | 2.6 | 0.05 | 2.0 | 6.9 | 6.7 | 0.09 |
| M103205H795-MY515 | 4.6 | 0.09 | 3.1 | 4.2 | 3.8 | 0.09 |
| M103205H795-MY516 | 4.0 | 0.12 | 3.1 | 12.9 | 9.0 | 0.12 |
| M103205H795-MY520 | 1.5 | 0.18 | 1.4 | 3.2 | 3.3 | 0.23 |
| M103205H795-MY521 | 2.3 | 0.16 | 2.4 | 3.7 | 3.1 | 0.16 |
| M103205H795-MY522 | 3.4 | 0.19 | 2.9 | 6.5 | 4.2 | 0.14 |
| M103205H795-MY523 | 3.8 | 0.17 | 3.6 | 5.2 | 4.2 | 0.15 |
| M103205H795-MY524 | 5.8 | 0.18 | 6.3 | 3.9 | 4.6 | 0.18 |
| M103205H795-MY525 | 3.5 | 0.26 | 3.3 | 6.9 | 3.8 | 0.19 |
| M103205H795-MY526 | 3.9 | 0.23 | 4.1 | 5.2 | 3.8 | 0.19 |
| M103205H795-MY527 | 5.3 | 0.24 | 6.3 | 3.8 | 3.3 | 0.18 |
| M103205H795-MY528 | 4.4 | 0.18 | 2.0 | 2.0 | 2.1 | 0.19 |
| M103205H795-MY529 | 5.0 | 0.16 | 3.0 | 2.1 | 3.3 | 0.20 |
| M103205H795-MY530 | 5.6 | 0.42 | 4.1 | 4.1 | 2.9 | 0.23 |
| M103205H795-MY531 | 6.7 | 0.36 | 2.4 | 2.7 | 3.1 | 0.28 |
| M103205H795-MY532 | 7.8 | 0.42 | 3.3 | 5.8 | 5.5 | 0.48 |
| M103205H795-MY533 | 7.7 | 0.33 | 3.3 | 5.5 | 4.8 | 0.45 |
| M103205H795-MY534 | 4.3 | 0.22 | 4.1 | 5.8 | 3.8 | 0.15 |
| M103205H795-MY535 | 4.4 | 0.17 | 1.8 | 1.7 | 2.4 | 0.16 |
| M103205H795-MY536 | 4.5 | 0.23 | 2.4 | 5.0 | 4.6 | 0.30 |
| M103205H795-MY537 | 5.6 | 0.24 | 2.5 | 3.0 | 4.6 | 0.25 |
| M103205H795-MY538 | 6.4 | 0.25 | 2.8 | 1.8 | 3.5 | 0.14 |

TABLE 24

Binding profile of the variants tested in all human FcγR transgenic mice

| Heavy chain name | CH | SEQ ID NO | Substitutions | KD (M) for cynoFcgRs | | | | | KD (M) for humanFcgRs | |
|---|---|---|---|---|---|---|---|---|---|---|
| | | | | FcgRIIa1 | FcgRIIa2 | FcgRIIa3 | FcgRIIb | FcgRIIIaS | FcgRIIaH | FcgRIIaR |
| M103205H795-SG1 | SG1 | 9 | — | 3.2E−06 | 3.2E−06 | 1.7E−05 | 1.8E−06 | 1.6E−07 | 6.5E−07 | 1.2E−06 |
| M103205H795-MY101 | MY101 | 229 | G236N/H268D/A330K/P396M | 1.1E−06 | 1.2E−06 | 3.5E−05 | 3.5E−07 | 1.2E−06 | 4.3E−07 | 2.7E−07 |
| M103205H795-PK2 | PK2 | 230 | G236N/H268D/A330K/P396M/S400R/D413K | 1.3E−06 | 2.3E−06 | 1.3E−05 | 3.2E−07 | 2.9E−06 | 5.7E−07 | 2.1E−06 |
| M103205H795-MY201 | MY201 | 231 | G236N/H268D/A330K | 1.4E−06 | 2.4E−06 | 2.9E−06 | 4.3E−07 | 5.7E−06 | 9.1E−07 | 1.9E−06 |
| M103205H795-MY352 | MY352 | 232 | G236N/H268D/Q311R/A330K/D413K | 9.2E−07 | 7.6E−06 | 1.5E−06 | 3.5E−07 | 3.2E−06 | 3.0E−06 | 1.6E−06 |
| M103205H795-MY205 | MY205 | 233 | G236N/H268D/Q295L/A330K | 9.0E−07 | 1.1E−06 | 3.0E−06 | 2.5E−07 | 6.0E−06 | 4.7E−07 | 1.3E−06 |
| M103205H795-MY144 | MY144 | 234 | G236N/H268D/Q295L/Q111R/A330K/4213K | 6.3E−07 | 1.1E−06 | 2.2E−06 | 3.1E−07 | 4.9E−06 | 0.7E−07 | 3.2E−06 |
| M103205H795-MY135 | MY135 | 235 | G236T/H268D/Q311R/A330K/D413K | 2.0E−06 | 1.7E−06 | 2.7E−06 | 6.5E−06 | 1.5E−06 | 2.9E−07 | 2.9E−07 |

| Heavy chain name | KD (M) for humanFcgRs | | KD fold for cynoFcgRs (SG1 = 1) | | | | | KD fold for humanFcgRs (SG1 = 1) | | | |
|---|---|---|---|---|---|---|---|---|---|---|---|
| | FcgRIIb | FcgRIIIaV | FcgRIIa1 | FcgRIIa2 | FcgRIIa3 | FcgRIIb | FcgRIIIaS | FcgRIIaH | FcgRIIaR | FcgRIIb | FcgRIIIaV |
| M103205H795-SG1 | 4.6E−06 | 8.1E−07 | 1.0 | 1.0 | 1.0 | 1.0 | 1.00 | 1.0 | 1.0 | 1.0 | 1.00 |
| M103205H795-MY101 | 4.9E−07 | 1.1E−06 | 2.5 | 1.3 | 4.7 | 5.0 | 0.11 | 1.0 | 1.3 | 9.4 | 0.07 |
| M103205H795-PK2 | 5.9E−07 | 1.3E−05 | 2.5 | 2.9 | 4.5 | 4.2 | 0.09 | 1.2 | 1.0 | 7.8 | 0.09 |
| M103205H795-MY201 | 1.1E−06 | 2.4E−05 | 2.3 | 3.6 | 4.4 | 4.2 | 0.06 | 0.5 | 0.6 | 4.2 | 0.03 |
| M103205H795-MY352 | 2.2E−06 | 1.4E−05 | 1.5 | 6.7 | 8.9 | 5.1 | 0.07 | 0.7 | 0.7 | 3.8 | 0.06 |
| M103205H795-MY205 | 5.6E−07 | 1.3E−05 | 3.6 | 4.6 | 5.2 | 7.2 | 0.06 | 1.5 | 0.8 | 8.3 | 0.06 |
| M103205H795-MY144 | 7.2E−07 | 1.9E−06 | 2.6 | 4.6 | 7.3 | 5.0 | 0.07 | 1.0 | 0.9 | 6.4 | 0.04 |
| M103205H795-MY135 | 2.3E−06 | 5.0E−06 | 1.6 | 3.0 | 6.3 | 2.8 | 0.24 | 2.4 | 3.8 | 2.0 | 0.16 |

Example 28

Evaluation of Clearance of Myostatin Using FcγRIIb-Enhanced Fc Variants in all Human FcγR Transgenic Mice The effect of clearance of myostatin by FcγRIIb-enhanced Fc variant constructed in Example 27 was evaluated in a mouse in which all murine FcγRs have been deleted and human FcγRs, encoded as transgenes, have been inserted into the mouse genome (Proc. Natl. Acad. Sci., 2012, 109, 6181). In this mice all mouse FcγRs are substituted with human ones so that the effect of affinity enhancement to human FcγRIIb on clearance of soluble antigen can be evaluated in mouse. Furthermore, pI-increasing substitutions were evaluated in combination with FcγRIIb-enhanced Fc variants constructed in Example 27.

Preparation and Profile of Tested Variants

The tested 8 antibodies and their binding profiles are summarized in Table 24. The heavy chain, MS103205H795-PK2, was prepared by introducing pI-increasing substitutions (S400R/D413K) into MS103205H795-MY101. MS103205H795-MY351, MS103205H795-MY344, MS103205H795-MY335 were prepared by introducing another pI-increasing substitutions (Q311R/D413K) into MS103205H795-MY201, MS103205H795-MY205, MS103205H795-MY265, respectively. All the MS1032LO06 variants were expressed with M103202L889-SK1 as light chain according to the method shown in Example 27 and their affinities to human and cynoFcγRs were evaluated using the method in Example 27.

Based on the SPR analysis summarized in Table 24, it was confirmed that the pI-increasing substitutions do not affect the FcγR binding of FcγRIIb-enhanced Fc variants. MY101 and PK2, which was prepared by introducing S400R/D413K into MY101, show 9-fold and 8-fold enhanced human FcγRIIb binding, respectively. The affinities of MY101 and PK2 to human FcγRIIa are remained comparable to SG1. With respect to other human and cynoFcγRs, they show almost the same binding profile. Similarly, MY351 showed similar binding profile with that of parent MY201, MY344 with that of parent MY205, and MY335 with that of parent MY265 (Table 21), respectively. These results indicate that either pair of pI-increasing substitutions, S400R/D413K or Q311R/D413K, does not affect the affinities to human and cynoFcγRs.

PK Study in all Human FcγR Transgenic Mice
In Vivo Test Using all Human FcγR Transgenic Mice The elimination of myostatin and anti-latent myostatin antibody were assessed in vivo upon co-administration of anti-latent myostatin antibody and human latent myostatin in all human FcγR transgenic mice (FIGS. 24 and 25). An anti-latent myostatin antibody (0.3 mg/ml) and latent myostatin (0.05 mg/ml) were administered at a single dose of 10 ml/kg into the caudal vein. Anti-CD4 antibody (1 mg/ml) was administered three times (every 10 days) at a dose of 10 ml/kg into the caudal vein to suppress anti-drug antibody. Blood was collected at 5 minutes, 15 minutes, 1 hour, 4 hours, 7 hours, 1 day, 2 days, 7 days, 14 days, 21 days, and 28 days after administration. The collected blood was centrifuged immediately at 15,000 rpm in 4° C. for 5 minutes to separate the plasma. The separated plasma was stored at or below −20° C. until measurement. The anti-latent myostatin antibodies used were MS1032LO06-SG1, MS1032LO06-MY101, MS1032LO06-PK2, MS1032LO06-MY201, MS1032LO06-MY351, MS1032LO06-MY205, MS1032LO06-MY344 and MS1032LO06-MY335.

Measurement of Total Myostatin Concentration in Plasma by Electrochemiluminescence (ECL)

The concentration of total myostatin in mouse plasma was measured by ECL. Anti-mature myostatin antibody-immobilized plates were prepared by dispensing anti-mature myostatin antibody RK35 (WO 2009058346) onto a MULTI-ARRAY 96-well plate (Meso Scale Discovery) and incubated overnight at 4° C. Mature myostatin calibration curve samples and mouse plasma samples diluted 4-fold or more were prepared. The samples were mixed in an acidic solution (0.2 M Glycine-HCl, pH2.5) to dissociate mature myostatin from its binding protein (such as propeptide). Subsequently, the samples were added onto an anti-mature myostatin antibody-immobilized plate, and allowed to bind for 1 hour at room temperature before washing. Next, BIOTIN TAG labelled anti-mature myostatin antibody RK22 (WO 2009/058346) was added and the plate was incubated for 1 hour at room temperature before washing. Next, SULFO TAG labelled streptavidin (Meso Scale Discovery) was added and the plate was incubated for 1 hour at room temperature before washing. Read Buffer T (×4) (Meso Scale Discovery) was immediately added to the plate and signal was detected by SECTOR Imager 2400 (Meso Scale Discovery). The mature myostatin concentration was calculated based on the response of the calibration curve using the analytical software SOFTMAX® PRO (Molecular Devices). The time course of total myostatin concentration in plasma after intravenous administration of anti-latent myostatin antibody and latent myostatin measured by this method is shown in FIG. 24.

Measurement of Anti-Latent Myostatin Antibody Concentration in Plasma by High-Performance Liquid Chromatography-Electrospray Tandem Mass Spectrometry (LC/ESI-MS/MS)

Anti-latent myostatin antibody concentration in mouse plasma was measured by LC/ESI-MS/MS. The concentrations of calibration standards were 1.56 25, 3.125, 6.25, 12.5, 25, 50, 100, and 200 µg/mL in mice plasma. Three µL of the calibration standards and plasma samples were added to 50 µL of Ab-Capture Mag (ProteNova), and allowed to incubate for 2 hours at room temperature. Afterward, the magnetic beads were recovered from samples and washed twice with 0.2 mL of 10 mmol/L PBS with 0.05% TWEEN® 20. Subsequently, the magnetic beads were washed with 10 mmol/L PBS to ensure the removal of TWEEN® 20. After washing, the magnetic beads were suspended in 25 µL of 7.5 mol/L Urea, 8 mmol/L dithiothreitol and 1 µg/mL lysozyme (chicken egg white) in 50 mmol/L ammonium bicarbonate and the suspended samples were incubated for 45 minutes at 56° C. Then, 2 µL of 500 mmol/L iodoacetoamide was added and the samples were incubated for 30 minutes at 37° C. in the dark. Next, Lysyl Endopeptidase digestion was carried out by adding 150 µL of 0.67 µg/mL Lysyl Endopeptidase for Biochemistry (Wako) in 50 mmol/L ammonium bicarbonate and the samples were incubated for 3 hr at 37° C. Subsequently, tryptic digestion was carried out by adding 10 µL of 10 µg/mL sequencing grade modified trypsin (Promega) in 50 mmol/L ammonium bicarbonate. Samples were allowed to digest under mixing overnight at 37° C., and quenched by adding 5 µL of 10% trifluoroacetic acid. Fifty µL of digestion samples were subjected to analysis by LC/ESI-MS/MS. LC/ESI-MS/MS was performed using Xevo TQ-S triple quadrupole instrument (Waters) equipped with 2D I-class UPLC (Waters). Anti-latent myostatin antibody specific peptide YAFGQGTK (SEQ ID NO:382) and Lysozyme specific peptide GTDVQAWIR (SEQ ID NO:383) as an internal standard were monitored by the selected reaction monitoring (SRM). SRM transition was [M+2H]2+ (m/z 436.2) to y8 ion (m/z 637.3) for anti-latent myostatin antibody, and [M+2H]2+ (m/z 523.3) to y8 ion (m/z 545.3) for lysozyme. Internal calibration curve was constructed by the weighted (1/x or 1/x2) linear regression using the peak area plotted against the concentrations. The concentration in mouse plasma was calculated from the calibration curve using the analytical software Masslynx Ver.4.1 (Waters). The time course of antibody concentration in plasma after intravenous administration of anti-latent myostatin antibody and latent myostatin measured by this method is shown in FIG. 25.

Effect of pI and FcγR Binding on Myostatin Concentration In Vivo

After administration of MS1032LO06-SG1, plasma total myostatin concentration at 7 hours decreased 5 fold compared to plasma total myostatin concentration at 5 minutes. In contrast, after administration of MS1032LO06-MY101, MS1032LO06-MY201 and MS1032LO06-MY205, plasma total myostatin concentration at 7 hours decreased 28-200 fold compared to plasma total myostatin concentration at 5 minutes. Furthermore, after administration of MS1032LO06-PK2, MS1032LO06-MY351, MS1032LO06-MY344 and MS1032LO06-MY335, plasma total myostatin concentration at 7 hours decreased 361-419 fold compared to plasma total myostatin concentration at 5 minutes. On the other hands, the difference in each antibody's concentration at each sampling point compared to MS1032LO06-SG1's was approximately within 2 fold, and pI variants did not increase antibody elimination from plasma. Both human FcγRIIb binding enhanced antibodies and pI-increasing substitutions increased elimination of myostatin, but not antibodies. High pI variants have more positive charge in plasma. Since this positive charge interacts with cell surface of negative charge, antigen-antibody immune complex of high pI variants get closer to cell surface, resulted in increased cellular uptake of antigen-antibody immune complex of high pI variants.

Example 29

Evaluation of Clearance of Myostatin Using FcγRIIb-Enhanced Fc Variants in Monkey The effect of enhanced binding of Fc variants developed in Example 27 to cynoFcγRIIb on myostatin sweeping was evaluated in cynomolgus monkey. And the combination effect with pI-increasing substitutions were also evaluated.

Preparation and Profile of Tested Variants

The tested 14 antibodies and their binding profiles are summarized in Table 25. It has been reported that Fc variant with enhanced binding to FcRn at acidic pH improve the antibody half-life in vivo (*J. Biol. Chem.* 2006 281:23514-23524 (2006); *Nat. Biotechnol.* 28:157-159 (2010), *Clin*

Pharm. & Thera. 89(2):283-290 (2011)). To improve the antibody half-life without binding to rheumatoid factor we combined these substitutions with FcγRIIb enhanced and pI-increased Fc variants.

The heavy chain, MS103205H795-SG1012, MS103205H795-SG1029, MS103205 H795-SG1031, MS103205H795-SG1033, MS103205H795-SG1034 were prepared by introducing a N434A substitution into MS103205H795-MY101, MS103205H795-MY344, MS103205H795-MY351, MS103205H795-MY201, MS103205H795-MY335, respectively. MS103205H795-SG1016 was prepared by introducing pI-increasing substitutions (Q311R/D399K) into MS103205H795-SG1012. MS103240H795-SG1071 and MS103240H795-SG1079 were prepared by introducing M428L/N434A/Y436T/Q438R/S440E substitutions and N434A/Q438R/S440E substitutions into MS103240 H795-MY344, respectively, (MS103240H795: VH, SEQ ID NO; 92).

MS103240H795-SG1074 and MS103240H795-SG1077 were prepared by introducing pI-increasing substitutions Q311R/P343R and M428L/N434A/Y436T/Q438R/S440E substitutions into MS103240H795-MY209 and MS103240H795-MY518, respectively. MS103240H795-SG1080 and MS103240H795-SG1081 were prepared by introducing pI-increasing substitutions Q311R/P343R and N434A/Q438R/S440E substitutions into MS103240H795-MY209 and MS103240H795-MY518, respectively. MS103240H795-SG1071 was prepared by introducing pI-increasing substitutions Q311R/D413K and M428L/N434A/Y436T/Q438R/S440E substitutions into MS103240H795-MY205. MS103240H795-SG1079 was prepared by introducing pI-increasing substitutions Q311R/D413K and N434A/Q438R/S440E substitutions into MS103240H795-MY205. These MS1032LO06 variants and MS1032LO19 variants were expressed with M103202L889-SK1 and M103202L1045-SK1, respectively, (M103202L1045: VL, SEQ ID NO: 97) as light chain according to the method shown in Example 34 and their affinities to human and cynoFcγRs were evaluated using the method in Example 27. In this example, the value of KD fold for each Fc variant was calculated by dividing the KD value of the parent SG1 by the KD value of the variant for each FcγR. For example, the value of KD fold for MS1032LO06-SG1012 and MS1032LO19-SG1071 were calculated by divinding the KD value of MS1032LO06-SG1 and MS1032LO19-SG1 by the KD value of MS1032LO06-SG1012 and MS1032LO19-SG1071, respectively.

TABLE 25

| Heavy chain name | CH | SEQ ID NO. | mutation |
|---|---|---|---|
| M103205H795-SG1 | SG1 | 9 | — |
| M103205H795-SG1012 | SG1012 | 236 | G236N/H268E/A330K/P396M/N434A |
| M103205H795-SG1016 | SG1016 | 237 | G236N/H268E/Q311N/A330K/P396M/D939R/N434A |
| M103205H795-SG1029 | SG1029 | 238 | G236N/H268D/Q295L/Q311R/A330K/D413K/N434A |
| M103205H795-SG1031 | SG1031 | 239 | G236N/H268D/Q311R/A330K/D413K/N434A |
| M103205H795-SG1033 | SG-1033 | 240 | G236N/H268D/A330K/N434A |
| M103205H795-SG1034 | SG1034 | 241 | G236T/H268D/Q311R/A330K/D413K/N434A |
| M103205H795-SG1 | SG1 | 9 | |
| M103205H795-SG1071 | SG1071 | 242 | G236N/H268D/Q295L/Q311R/A330K/D413K/M428L/N434A/Y436T/Q438R/S440E |
| M103205H795-SG1074 | SG1074 | 243 | G236N/H268D/Q295L/Q311R/K326T/A330K/P343R/M428L/N434A/Y436T/Q438R/S440E |
| M103205H795-SG1077 | SG1077 | 244 | L235W/G236N/H268D/Q295L/Q311R/K326T/A330K/P343R/M428L/N434A/Y436T/Q438R/S440E |
| M103205H795-SG1079 | SG1079 | 245 | G236N/H268D/Q295L/Q311R/A330K/P343R//N434A/Q438R/S440E |
| M103205H795-SG1080 | SG1080 | 246 | G236N/H268D/Q295L/Q311R/K326T/A330K/P343R/N434A/Q438R/S440E |
| M103205H795-SG1081 | SG1081 | 247 | L235W/G236N/H268D/Q295L/Q311R/K326T/A330K/P343R/N434A/Q438R/S440E |

| | KD (M) for cynoFcgRs | | | | | KD (M) for humanFcgRs | | | |
|---|---|---|---|---|---|---|---|---|---|
| Heavy chain name | FcgRIIa1 | FcgRIIa2 | FcgRIIa3 | FcgRIIb | FcgRIIIaS | FcgRIIaH | FcgRIIaR | FcgRIIb | FcgRIIIaV |
| M103205H795-SG1 | 4.8E−06 | 4.7E−06 | 6.6E−06 | 1.2E−06 | 2.6E−07 | 8.9E−07 | 1.0E−08 | 4.2E−06 | 6.2E−07 |
| M103205H795-SG1012 | 1.1E−06 | 1.0E−06 | 2.3E−06 | 2.7E−07 | 2.1E−06 | 5.0E−07 | 2.5E−07 | 4.9E−07 | 5.8E−06 |
| M103205H795-SG1016 | 2.3E−06 | 1.1E−06 | 2.2E−06 | 3.3E−07 | 2.4E−06 | 6.0E−07 | 8.2E−07 | 5.5E−07 | 1.0E−05 |
| M103205H795-SG1029 | 1.4E−06 | 1.5E−06 | 3.1E−06 | 4.0E−07 | 5.3E−06 | 3.9E−07 | 1.3E−06 | 9.0E−07 | 2.0E−05 |
| M103205H795-SG1031 | 1.8E−06 | 1.3E−06 | 2.8E−06 | 5.0E−07 | 4.4E−06 | 1.3E−06 | 8.0E−07 | 1.2E−06 | 1.5E−05 |
| M103205H795-SG1033 | 1.8E−06 | 1.5E−06 | 3.0E−06 | 5.8E−07 | 4.4E−06 | 1.2E−06 | 1.0E−06 | 1.2E−06 | 1.2E−06 |
| M103205H795-SG1034 | 3.1E−06 | 2.7E−06 | 4.2E−06 | 8.8E−07 | 2.2E−06 | 3.1E−07 | 2.5E−07 | 2.6E−06 | 7.1E−07 |
| M103205H795-SG1 | 4.8E−06 | 4.7E−06 | 6.6E−06 | 1.2E−07 | 2.6E−07 | 8.9E−07 | 0.6E−07 | 3.3E−06 | 5.8E−05 |
| M103205H795-SG1071 | 1.2E−06 | 1.3E−06 | 2.1E−06 | 3.3E−07 | 3.8E−06 | 6.9E−07 | 1.2E−06 | 6.8E−07 | 1.5E−06 |
| M103205H795-SG1074 | 7.0E−07 | 6.8E−07 | 1.1E−06 | 1.6E−07 | 1.4E−06 | 4.6E−07 | 5.4E−07 | 3.8E−07 | 4.5E−06 |
| M103205H795-SG1077 | 1.4E−06 | 1.3E−06 | 2.0E−06 | 3.2E−07 | 2.9E−06 | 3.8E−07 | 6.9E−07 | 5.1E−07 | 3.4E−06 |
| M103205H795-SG1079 | 1.1E−06 | 1.2E−06 | 2.1E−06 | 3.8E−07 | 3.3E−06 | 6.7E−07 | 1.2E−07 | 6.9E−07 | 3.2E−06 |
| M103205H795-SG1080 | 6.1E−07 | 6.8E−07 | 1.1E−06 | 1.4E−07 | 1.4E−06 | 4.6E−07 | 5.6E−07 | 3.7E−07 | 4.6E−06 |
| M103205H795-SG1081 | 1.4E−06 | 2.3E−06 | 2.1E−06 | 2.9E−07 | 2.9E−06 | 9.9E−07 | 6.8E−07 | 5.0E−07 | 3.4E−06 |

| | KD fold for cynoFcgRs (SG1 = 1) | | | | | KD fold for humanFcgRs (SG1 = 1) | | | |
|---|---|---|---|---|---|---|---|---|---|
| Heavy chain name | FcgRIIa1 | FcgRIIa2 | FcgRIIa3 | FcgRIIb | FcgRIIIaS | FcgRIIaH | FcgRIIaR | FcgRIIb | FcgRIIIaV |
| M103205H795-SG1 | 1.0 | 1.0 | 1.0 | 1.0 | 1.00 | 1.0 | 1.0 | 1.0 | 1.00 |
| M103205H795-SG1012 | 4.4 | 4.7 | 3.8 | 7.2 | 0.11 | 1.8 | 1.4 | 0.5 | 0.11 |
| M103205H795-SG1016 | 3.8 | 4.1 | 3.9 | 6.0 | 0.17 | 1.8 | 1.2 | 0.7 | 0.06 |
| M103205H795-SG1029 | 3.5 | 8.1 | 2.8 | 4.9 | 0.05 | 1.5 | 0.6 | 5.9 | 0.03 |
| M103205H795-SG1031 | 2.6 | 5.1 | 3.1 | 5.9 | 0.05 | 0.7 | 1.7 | 3.2 | 0.04 |
| M103205H795-SG1033 | 2.8 | 3.0 | 2.9 | 3.9 | 0.06 | 0.5 | 1.0 | 1.0 | 0.09 |
| M103205H795-SG1034 | 1.5 | 1.7 | 2.0 | 2.2 | 0.11 | 2.7 | 4.1 | 1.0 | 0.03 |

TABLE 25-continued

| | | | | | | | | | |
|---|---|---|---|---|---|---|---|---|---|
| M103205H795-SG1 | 1.0 | 1.0 | 1.0 | 1.0 | 1.00 | 1.0 | 1.0 | 5.8 | 1.00 |
| M103205H795-SG1071 | 3.0 | 3.2 | 3.1 | 5.3 | 0.07 | 1.4 | 0.8 | 5.7 | 0.04 |
| M103205H795-SG1074 | 5.4 | 8.1 | 5.2 | 11.0 | 0.19 | 1.2 | 1.1 | 10.7 | 0.13 |
| M103205H795-SG1077 | 2.7 | 3.1 | 3.3 | 5.4 | 0.09 | 1.0 | 1.4 | 7.5 | 0.17 |
| M103205H795-SG1079 | 3.4 | 3.4 | 3.2 | 5.7 | 0.04 | 1.4 | 0.1 | 5.6 | 0.18 |
| M103205H795-SG1080 | 5.8 | 6.1 | 6.1 | 12.6 | 0.18 | 2.5 | 1.7 | 10.5 | 0.19 |
| M103205H795-SG1081 | 2.7 | 3.2 | 3.1 | 3.9 | 0.09 | 1.0 | 1.4 | 7.7 | 0.17 |

The SPR analysis results are summarized in Table 25. Among these variants, SG1012, SG1016, SG1074 and SG1080 show the strongest affinity to human FcγRIIb, which has 10 fold enhanced affinity to human FcγRIIb compared to SG1.

PK Study in Monkey

In Vivo Test Using Cynomolgus Monkey

The accumulation of endogenous myostatin was assessed in vivo upon administration of an anti-latent myostatin antibody in 2-4 year old *Macaca fascicularis* (cynomolgus monkey) from Cambodia (Shin Nippon Biomedical Laboratories Ltd., Japan). An anti-latent myostatin antibody was administered at a dose level of 30 mg/kg into the cephalic vein of the forearm using a disposable syringe, extension tube, indwelling needle, and infusion pump. The dosing speed was 30 minutes per body. Blood was collected before the start of dosing and either 5 minutes, 7 hours and 1, 2, 3, 7, 14, 21, 28, 35, 42, 49 and 56 days after the end of dosing, or 5 minutes and 2, 4, and 7 hours and 1, 2, 3, 7, 14, 21, 28, 35, 42, 49 and 56 days after the end of dosing. Blood was drawn from the femoral vein with a syringe containing heparin sodium. The blood was immediately cooled on ice, and plasma was obtained by centrifugation at 4° C., 1700×g for 10 minutes. The plasma samples were stored in a deep freezer (acceptable range: −70° C. or below) until measurement. The anti-latent myostatin antibodies used were MS1032LO00-SG1, MS1032LO06-SG1012, MS1032LO06-SG1016, MS1032LO06-SG1029, MS1032LO06-SG1031, MS1032LO06-SG1033, and MS1032LO06-SG1034.

A dose level of 2 mg/kg was administered into the cephalic vein of the forearm or saphenous vein using a disposable syringe, and indwelling needle for the anti-latent myostatin antibodies MS1032LO19-SG1079, MS1032LO19-SG1071, MS1032LO19-SG1080, MS1032LO19-SG1074, MS1032LO19-SG1081, and MS1032LO19-SG1077. Blood was collected before the start of dosing and 5 minutes and 2, 4, and 7 hours and 1, 2, 3, 7, 14 days after the end of dosing. The blood was processed as described above. Plasma samples were stored in a deep freezer (acceptable range: −70° C. or below) until measurement.

Measurement of Total Myostatin Concentration in Plasma by Electrochemiluminescence (ECL)

The concentration of total myostatin in monkey plasma was measured by ECL as described in Example 23. The time course of plasma total myostatin concentration after intravenous administration of anti-latent myostatin antibody as measured by this method is shown in FIG. 26.

Measurement of ADA in Monkey Plasma Using Electrochemiluminescence (ECL)

Biotinylated drug was coated onto a MULTI-ARRAY 96-well streptavidin plate (Meso Scale Discovery) and incubated in low cross buffer (Candor) for 2 hours at room temperature. Monkey plasma samples were diluted 20 fold in low cross buffer before addition to the plate. Samples were incubated overnight at 4° C. On the next day, the plate was washed thrice with wash buffer before addition of SULFO TAG labelled anti monkey IgG secondary antibody (Thermo Fisher Scientific). After incubating for an hour at room temperature, the plate was washed three times with wash buffer. Read Buffer T (×4) (Meso Scale Discovery) was immediately added to the plate and signal was detected using a SECTOR Imager 2400 (Meso Scale Discovery).

Effect of pH-Dependent and Fc Engineering on Myostatin Accumulation in Monkey In Vivo In cynomolgus monkey, the administration of a non pH-dependent anti-latent myostatin antibody (MS1032LO00-SG1) resulted in an at least 60 fold increase in myostatin concentration from baseline at day 28. At day 28, the administration of pH-dependent anti-latent myostatin antibodies MS1032LO06-SG1012 and MS1032LO06-SG1033 resulted in an 3 fold and 8 fold increase in myostatin concentration from baseline, respectively. The strong sweeping of myostatin was mainly contributed by the increase in affinity to cynomolgus monkey FcγRIIb. At day 28, pH-dependent anti-latent myostatin antibodies MS1032LO06-SG1029, MS1032LO06-SG1031 and MS1032LO06-SG1034 could sweep myostatin to below baseline. The reasons for strong myostatin sweeping of MS1032LO06-SG1029, MS1032LO06-SG1031 and MS1032LO06-SG1034 are an increase in non-specific uptake in the cell due to increase in positive charge cluster of the antibody and/or an increase in FcγR-mediated cellular uptake due to enhanced binding to FcγR.

The administration of the pH-dependent anti-latent myostatin antibodies MS1032LO19-SG1079, MS1032LO19-SG1071, MS1032LO19-SG1080, MS1032LO19-SG1074, MS1032LO19-SG1081 and MS1032LO19-SG1077 reduced myostatin concentration to below the detection limit (<0.25 ng/mL) from day 1 in cynomolgus monkey. On day 14, the concentration of myostatin increased above detectable limit for the antibodies MS1032LO19-SG1079 and MS1032LO19-SG1071, while the concentration of myostatin remained below the detectable limit for the antibodies MS1032LO19-SG1080, MS1032LO19-SG1074, MS1032LO19-SG1081 and MS1032LO19-SG1077. The weaker suppression of MS1032LO19-SG1079 and MS1032LO19-SG1071 antibodies could be due to the differences in pI mutations that are contained in these antibodies.

The data suggests that strong sweeping of myostatin from the plasma was achieved by mutations in the anti-myostatin antibodies that increase binding to FcγRIIb or that increase the positive charge of the antibody and increase binding to FcγRIIb. It is expected that strong sweeping of myostatin could be achieved in human by combining mutations that increase positive charge of the antibody and increase binding to FcγR.

Example 30

Screening of pI-Increased Substitutions to Enhance Clearance of Myostatin

To enhance the clearance of myostatin, pI increased substitutions in Fc portion of antibody were evaluated in this example. The method of adding amino acid substitutions to the antibody constant region to increase pI is not particularly limited, but for example, it can be performed by the method described in WO 2014/145159. As in the case with the variable region, amino acid substitutions introduced into the constant region are preferably those that decrease the number of negatively charged amino acids (such as aspartic acid and glutamic acid) while increasing the positively charged amino acids (such as arginine and lysine). Furthermore, amino acid substitutions may be introduced at any position in the antibody constant region, and may be a single amino acid substitution or a combination of multiple amino acid substitutions. Without particular limitation, the sites for introducing amino acid substitutions are preferably positions where amino acid side chains may be exposed on the antibody molecule surface. Particularly preferable examples include the method of introducing a combination of multiple amino acid substitutions at such positions that are exposed on the antibody molecule surface. Alternatively, the multiple amino acid substitutions introduced here are preferably positioned so that they are structurally close to each other. Furthermore, without particular limitation, the multiple amino acid substitutions introduced herein are preferably substitutions to positively charged amino acids, so that preferably they result in a state where multiple positive charges are present at structurally proximal positions.

Preparation and Profile of Tested Variants

The tested antibodies are summarized in Table 26. The heavy chain, MS103205H795-SG141 was prepared by introducing pI-increasing substitutions Q311R/D399R into MS103205H795-SG1. Other heavy chain variants were also prepared by introducing respective substitutions represented in Table 26 into MS103205H795-SG1. All the MS1032LO06 variants were expressed with M103202L889-SK1 as light chain according to the method shown in Example 34.

Mouse FcγRII-Binding Assay of pI-Increased Fc Variants Using BIACORE®

Regarding the produced Fc region variant-containing antibodies, binding assays between soluble mouse FcγRII and antigen-antibody complexes were performed using BIACORE® T200 (GE Healthcare). Soluble mouse FcγRII was produced in the form of a His-tagged molecule by a method known to those skilled in the art. An appropriate amount of an anti-His antibody was fixed onto Sensor chip CM5 (GE Healthcare) by the amine coupling method using a His capture kit (GE Healthcare) to capture mouse FcγRII. Next, an antibody-antigen complex and a running buffer (as a reference solution) were injected, and interaction was allowed to take place with the mouse FcγRII captured onto the sensor chip. 20 mM N-(2-Acetamido)-2-aminoethanesulfonic acid, 150 mM NaCl, 1.2 mM CaCl$_2$, and 0.05% (w/v) TWEEN® 20 at pH7.4 was used as the running buffer, and the respective buffer was also used to dilute the soluble mouse FcγRII. To regenerate the sensor chip, 10 mM glycine-HCl at pH1.5 was used. All measurements were carried out at 25° C. Analyses were performed based on binding (RU) calculated from sensorgrams obtained by the measurements, and relative values when the binding amount of SG1 was defined as 1.00 are shown. To calculate the parameters, the BIACORE® T100 Evaluation Software (GE Healthcare) was used.

TABLE 26

Summary of pI-increased Fc variants

| Heavy chain name | Substitutions | celluar uptake | biscore IC binding |
|---|---|---|---|
| M103205H795-SG1 | | 1.00 | 1.00 |
| M103205H795-SG141 | Q311R/D399R | 4.42 | 1.64 |
| M103205H795-P1378m | Q311R/D413K | 3.43 | 1.21 |
| M103205H795-P1378m | S400R/D413K | 3.86 | 1.23 |
| M103205H795-P1388m | Q311R/S400R/D413K | 6.68 | 1.41 |
| M103205H795-P1484m | Q311R/D312R | 0.00 | 1.33 |
| M103205H795-P1485m | Q311R/N315R | 1.85 | 1.29 |
| M103205H795-P1486m | Q311R/N815R | 1.52 | 1.20 |
| M103205H795-P1487m | Q311R/N384R | 1.23 | 1.46 |
| M103205H795-P1488m | Q311R/N384K | 1.45 | 1.43 |
| M103205H795-P1489m | Q311R/E318K | 1.68 | 1.24 |
| M103205H795-P1490m | Q311R/E318K | 1.33 | 1.28 |
| M103205H795-P1491m | Q311R/E333E | 1.37 | 1.05 |
| M103205H795-P1492m | Q311R/E333K | 1.13 | 0.55 |
| M103205H795-P1493m | Q311R/T335K | 0.99 | 1.10 |
| M103205H795-P1494m | Q311R/T335K | 1.12 | 1.14 |
| M103205H795-P1495m | Q311R/S337R | 1.76 | 1.30 |
| M103205H795-P1496m | Q311R/S337K | 1.69 | 1.28 |
| M103205H795-P1497m | Q311R/Q342R | 1.85 | 1.49 |
| M103205H795-P1498m | Q311R/Q342K | 1.56 | 1.35 |
| M103205H795-P1499m | Q311R/P343R | 3.61 | 1.98 |
| M103205H795-P1500m | Q311R/P343K | 1.62 | 1.32 |
| M103205H795-P1501m | Q311R/D413R | 2.40 | 1.52 |
| M103205H795-P1522m | Q311R/H265R | 2.13 | 1.24 |
| M103205H795-P1523m | Q311R/H265K | 1.91 | 1.19 |
| M103205H795-P1524m | Q311R/G341R | 3.68 | 1.40 |
| M103205H795-P1525m | Q311R/G341K | 3.55 | 1.31 |
| M103205H795-P1526m | Q311R/G885R | 1.20 | 1.04 |
| M103205H795-P1527m | Q311R/G885K | 0.92 | 0.95 |
| M103205H795-P1528m | Q311R/E366K | 3.02 | 1.12 |
| M103205H795-P1529m | Q311R/E366K | 2.86 | 1.08 |
| M103205H795-P1530m | Q311R/N390R | 3.12 | 1.09 |
| M103205H795-P1531m | Q311R/N390K | 2.35 | 1.01 |
| M103205H795-P1532m | Q311R/D401R | 4.16 | 1.23 |
| M103205H795-P1533m | Q311R/D401K | 3.52 | 1.18 |
| M103205H795-P1534m | Q311R/G402K | 3.12 | 1.12 |
| M103205H795-P1535m | Q311R/G402K | 2.49 | 1.11 |
| M103205H795-P1536m | Q311R/G420R | 2.05 | 1.16 |
| M103205H795-P1537m | Q311R/N422E | 2.77 | 1.32 |
| M103205H795-P1538m | Q311R/N422K | 1.64 | 1.11 |
| M103205H795-P1539m | Q311R/A413R | 8.20 | 0.90 |
| M103205H795-P1540m | D401R/D413K | 7.64 | 1.73 |
| M103205H795-P1541m | D401K/D413K | 7.17 | 1.57 |
| M103205H795-P1542m | G402K/D413K | 3.22 | 1.21 |
| M103205H795-P1543m | G402K/D413K | 3.70 | 1.19 |
| M103205H795-P1544m | Q311R/D401R/D413K | 7.66 | 2.04 |
| M103205H795-P1545m | Q311R/D401K/D413K | 7.78 | 1.80 |
| M103205H795-P1546m | Q311R/G402R/D413K | 5.10 | 1.41 |
| M103205H795-P1547m | Q311R/G402K/D413K | 4.85 | 1.33 |
| M103205H795-P1548m | Q311R/G355R/D401R | 2.80 | 1.37 |
| M103205H795-P1549m | Q311R/G355R/G402R | 2.03 | 1.22 |
| M103205H795-P1550m | Q311R/E386R/D401R | 6.43 | 1.68 |
| M103205H795-P1551m | Q311R/E386R/G402R | 2.91 | 1.33 |
| M103205H795-P1552m | G385R/D401R/D413K | 4.44 | 2.19 |
| M103205H795-P1553m | G385R/G402R/D413K | 2.86 | 1.47 |
| M103205H795-P1555m | E888R/G4402R/D413K | 3.71 | 2.01 |

The SPR analysis results are summarized in Table 26. A few Fc variants were shown to have enhanced affinity toward mouse FcγRII fixed on the BIACORE® sensor chip.

While not being restricted to a particular theory, this result can be explained as follows. The BIACORE® sensor chip is known to be negatively charged, and this charged state can be considered to resemble the cell membrane surface. More specifically, the affinity of an antigen-antibody complex for mouse FcγRII fixed onto the negatively charged BIACORE® sensor chip is surmised to resemble the manner in which the antigen-antibody complex binds to mouse FcγRII present on a similarly negatively charged cell membrane surface.

Here, the antibodies produced by introducing pI-increasing modifications into the Fc region are antibodies in which the charge of the Fc region is more towards the positive side when compared with before introduction of the modifications. Therefore, the Coulombic interaction between the Fc region (positive charge) and the sensor chip surface (negative charge) can be considered to have been strengthened by the pI-increasing amino acid modifications. Furthermore, such effects are expected to take place similarly on the same negatively charged cell membrane surface; therefore, they are also expected to show an effect of accelerating the speed of uptake into cells in vivo.

Among the pI increased Fc variants with two amino acid substitution from SG1, the antigen-antibody complex made by SG141, P1499m, P1501 m and P1540m shows highest binding to human FcγRIIb. The amino acid substitutions on Q311R/D399R, Q311R/P343R, Q311R/D413R and D401R/D413K are supposed to have strong charge effect on binding to human FcγRIIb on the sensor chip.

Cellular Uptake of pI-Increased Fc Variants

To evaluate the rate of intracellular uptake into a human FcγRIIb-expressing cell line, following assay was performed. An MDCK (Madin-Darby canine kidney) cell line that constitutively expresses human FcγRIIb was produced by known methods. Using these cells, intracellular uptake of antigen-antibody complexes was evaluated.

Specifically, PHRODO® Red (Life Technologies) was used to label human latent Myostatin (antigen) according to an established protocol, and antigen-antibody complexes were formed in a culture solution with the antibody concentration being 10 mg/mL and the antigen concentration being 2.5 mg/mL. The culture solution containing the antigen-antibody complexes was added to culture plates of the above-mentioned MDCK cells which constitutively express human FcγRIIb and incubated for one hour, and then the fluorescence intensity of the antigen taken up into the cells was quantified using InCell Analyzer 6000 (GE healthcare). The amount of antigen taken up was presented as relative values to the SG1 value which is taken as 1.00.

The quantification results of cellular uptake were summarized in Table 26. Strong fluorescence derived from the antigen in the cells was observed in several Fc variants.

While not being restricted to a particular theory, this result can be explained as follows.

The antigen and antibodies added to the cell culture solution form antigen-antibody complexes in the culture solution. The antigen-antibody complexes bind to human FcγRIIb expressed on the cell membrane via the antibody Fc region, and are taken up into the cells in a receptor-dependent manner. Antibodies used in this experiment binds to antigen in a pH-dependent manner; therefore, the antibody can dissociate from the antigen in the endosomes (acidic pH conditions) inside the cells. Since the dissociated antigen is labeled with PHRODO® Red as described earlier, it fluoresces in the endosomes. Thus, a strong fluorescence intensity inside the cell is thought to indicate that the uptake of the antigen-antibody complexes into the cells is taking place more quickly or in larger amounts.

Among the pI increased Fc variants with two amino acid substitution from SG1, the antigen-antibody complex made by SG141, P1375m, P1378m, P1499m, P1524m, P1525m, P1532m, P1533m, P1540m, P1541m and P1543m shows stronger antigen uptake into the cells. The amino acid substitutions on Q311R/D399R, Q311R/D413K, S400R/D413K, Q311R/P343R, Q311R/G341R, Q311R/G341K, Q311R/D401R, Q311R/D401K, D401R/D413K, D401K/D413K and G402K/D413K are supposed to have strong charge effect on antigen antibody complex uptake into the cells.

PK Study in Human FcRn Transgenic Mouse

In Vivo Test Using Human FcRn Transgenic Mice

The elimination of myostatin and anti-latent myostatin antibody were assessed in vivo upon co-administration of anti-latent myostatin antibody and latent myostatin in human FcRn transgenic mice in which mouse FcRn was substituted with human FcRn. An anti-latent myostatin antibody (0.1 mg/ml) and mouse latent myostatin (0.05 mg/ml) were administered at a single dose of 10 ml/kg into the caudal vein in the experiment PK-2 (described in FIG. 27). An anti-latent myostatin antibody (0.3 mg/ml), human latent myostatin (0.05 mg/ml) and human normal immunoglobulin (CSL Behring AG) (100 mg/ml) were administered at a single dose of 10 ml/kg into the caudal vein in the experiment PK-4 (described in FIG. 28). Blood was collected at 5 minutes, 15 min, 1 hour, 4 hours, 7 hours, 1 day, 2 days, 7 days, 14 days, 21 days, and 28 days after administration in the experiment PK-2. Blood was collected at 5 minutes, 1 hour, 4 hours, 7 hours, 1 day, 7 days, 14 days, 21 days, and 30 days after administration in the experiment PK-4. The collected blood was centrifuged immediately at 15,000 rpm in 4° C. for 5 minutes to separate the plasma. The separated plasma was stored at or below −20° C. until measurement. The anti-latent myostatin antibodies used were MS1032LO06-SG1, MS1032LO06-P1375m, MS1032LO06-P1378m, MS1032LO06-P1383 m in the experiment PK-2, and MS1032LO06-P1375m, MS1032LO06-P1499m in the experiment PK-4.

Measurement of Total Myostatin Concentration in Plasma by Electrochemiluminescence (ECL)

The concentration of total myostatin in mouse plasma was measured by ECL as described in Example 28 (Ravetch PK). The time course of total myostatin concentration in plasma after intravenous administration of anti-latent myostatin antibody and latent myostatin measured by this method is shown in FIGS. 27A and 28A.

Measurement of Anti-Latent Myostatin Antibody Concentration in Plasma by Enzyme-Linked Immunosorbent Assay (ELISA)

The concentration of anti-latent myostatin antibody in mouse plasma was measured by ELISA in the experiment PK-2. Anti-human IgG (γ-chain specific) F(ab')2 antibody fragment (Sigma) was dispensed onto a Nunc-ImmunoPlate MAXISORP™ (Nalge Nunc International) and allowed to stand overnight at 4° C. to prepare anti-human IgG-immobilized plates. Calibration curve samples having plasma concentrations of 2.5, 1.25, 0.625, 0.313, 0.156, 0.078, and 0.039 µg/ml, and mouse plasma samples diluted 100-fold or more were prepared. Then, the samples were dispensed onto the anti-human IgG-immobilized plates, and allowed to stand for 1 hour at room temperature. Subsequently, Goat Anti-Human IgG (γ-chain specific) Biotin conjugate (Southern Biotech) was added to react for 1 hour at room temperature. Then, Streptavidin-PolyHRP80 (Stereospecific Detection Technologies) was added to react for one hour at room temperature, and chromogenic reaction was carried out using TMB One Component HRP Microwell Substrate (BioFX Laboratories) as a substrate. After stopping the reaction with 1 N sulfuric acid (Showa Chemical), the absorbance at 450 nm was measured by a microplate reader. The concentration in mouse plasma was calculated from the absorbance of the calibration curve using the analytical software SOFTMAX® PRO (Molecular Devices). The time course of antibody concentration in plasma after intravenous administration of anti-latent myostatin antibody and latent myostatin measured by this method is shown in FIG. 27B.

The concentration of anti-latent myostatin antibody in mouse plasma was measured by a Gyrolab Bioaffy™ CD (Gyros) in the experiment PK-4. Biotinylated anti-human IgG Fc antibody was flowed over the streptavidin bead column within the microstructure of the CDs. Calibration curve samples having plasma concentrations of 0.5, 1, 2, 4, 8, 16, and 32 μg/ml spiking plasma concentrations of 5 mg/mL of human normal immunoglobulin (CSL Behring AG) and 200 μg/ml of mouse latent myostatin, and mouse plasma samples diluted 25-fold or more spiking plasma concentrations of 200 μg/ml of mice latent myostatin were prepared. Then the samples were added into CDs and flowed over the bead column. Subsequently, Alexa-labeled Goat anti-human IgG polyclonal antibody (BETHYL) was added into CDs and flowed over the bead column. The concentration in mouse plasma was calculated from the response of the calibration curve using the Gyrolab Evaluator Program. The time course of antibody concentration in plasma after intravenous administration of anti-latent myostatin antibody and latent myostatin measured by this method is shown in FIG. 28B.

Effect of pI on Myostatin Concentration In Vivo

After administration of MS1032LO06-SG1, plasma total myostatin concentration at 7 hours decreased 12 fold compared to plasma total myostatin concentration at 5 minutes in the experiment PK-2. In contrast, after administration of MS1032LO06-P1375m, MS1032LO06-P1378m and MS1032LO06-P1383m, plasma total myostatin concentration at 7 hours decreased 26-67 fold compared to plasma total myostatin concentration at 5 minutes in the experiment PK-2. Antibody concentration of MS1032LO06-P1378m and MS1032LO06-P1383m decreased more than 3 fold compared to that of MS1032LO06-SG1, although the difference in MS1032LO06-P1375m's concentration at each sampling point compared to MS1032LO06-SG1's was within 2 fold in the experiment PK-2. pI variants including the amino acid substitutions on Q311R/D413K showed enhancement of myostatin elimination from plasma without enhancement of antibody elimination from plasma.

Furthermore, total myostatin concentration and antibody concentration after administration of MS1032LO06-P1499m were evaluated under co-administration of human normal immunoglobulin to mimic human plasma. After administration of MS1032LO06-P1375m and MS1032LO06-P1499m, plasma total myostatin concentration at 7 hours decreased 3.4 and 5.3 fold compared to plasma total myostatin concentration at 5 minutes, and total myostatin concentration and antibody concentration at each sampling point in MS1032LO06-P1499m was within 1.5 fold compared to that in MS1032LO06-P1375m in the experiment PK-4. pI variants including the amino acid substitutions on Q311R/P343R also showed enhancement of myostatin elimination from plasma without enhancement of antibody elimination from plasma.

High pI variants have more positive charge in plasma. Since this positive charge interacts with cell surface of negative charge, antigen-antibody immune complex of high pI variants get closer to cell surface, resulted in increased cellular uptake of antigen-antibody immune complex of high pI variants.

Example 31

PI-Increased Substitutions in Combination with FcγRIIb-Enhanced Fc Variant

The effect of clearance of myostatin by FcγRIIb-enhanced Fc variant in combination with other pI-increasing substitutions were evaluated in human FcγRIIb transgenic mice. Human FcγRIIb transgenic mice were generated by microinjection of BAC (bacterial artificial chromosome) vector containing all the exons of human FCGR2B gene into the pronucleus of fertilized eggs of C57BL/6N by standard techniques (see, e.g., J. Immunol., 2015 Oct. 1; 195(7): 3198-205). Mouse FcγRIIb deficient mice were generated using zinc finger nucleases (ZFNs) which was designed to target exon 1. The Humanized FcγRIIb mice were established by crossing human FcγRIIb transgenic mice with mouse FcγRIIb KO mice. Using this mouse, the combination effect of affinity enhancement to human FcγRIIb and pI increase on clearance of soluble antigen can be evaluated.

TABLE 27

| Heavy chain name | CH | SEQ ID NO. | Substitutions | KD (M) for cynoFcgRs ||||| KD (M) for humanFcgRs ||
|---|---|---|---|---|---|---|---|---|---|---|
| | | | | FcgRIIa1 | FcgRIIa2 | FcgRIIa3 | FcgRIIb | FcgRIIIaS | FcgRIIaH | FcgRIIaR |
| M103205H795-SG1 | SG1 | 9 | — | 4.8E−06 | 4.7E−06 | 8.6E−06 | 1.9E−0.6 | 2.6E−07 | 8.9E−07 | 1.0E−05 |
| M103205H795-MY201 | MY201 | 231 | G236N/H238D/A330K | 1.5E−06 | 1.2E−06 | 1.8E−06 | 3.3E−07 | 3.7E−06 | 9.8E−07 | 1.2E−06 |
| M103205H795-MY351 | MY351 | 232 | G236N/H268D/Q311R/ A330K/D413K | 1.6E−06 | 1.3E−06 | 2.2E−06 | 3.8E−07 | 4.1E−06 | 1.2E−08 | 1.6E−06 |
| M103205H795-MY352 | MY352 | 248 | G235N/H268D/Q911R/ A330K/D413R | 1.7E−06 | 1.3E−06 | 2.2E−06 | 4.2E−07 | 4.0E−06 | 1.2E−06 | 1.6E−06 |
| M103205H795-PY55 | PK55 | 249 | G235N/H268D/Q111R/ A330K/P341R | 1.4E−06 | 1.2E−06 | 2.0E−06 | 3.6E−07 | 3.3E−06 | 8.3E−07 | 1.5E−06 |
| M103205H795-PY56 | PK56 | 250 | G236N/H268D/Q311R/ A330K/P383R/D413R | 1.8E−06 | 1.5E−06 | 3.5E−06 | 5.5E−07 | 4.4E−06 | 1.2E−06 | 1.9E−06 |
| M103205H795-PY57 | PK57 | 251 | G236N/H268D/Q311R/ A330K/N384R/D413R | 1.9E−06 | 1.7E−06 | 3.1E−06 | 5.2E−07 | 4.3E−06 | 1.3E−06 | 2.2E−05 |

| Heavy chain name | KD (M) for humanFcgRs || KD fold for cynoFcgRs (SG1 = 1) ||||| KD fold for humanFcgRs (SG1 = 1) |||| 
|---|---|---|---|---|---|---|---|---|---|---|---|
| | FcgRIIb | FcgRIIIaV | FcgRIIa1 | FcgRIIa2 | FcgRIIa3 | FcgRIIb | FcgRIIIaS | FcgRIIaH | FcgRIIaR | FcgRIIb | FcgRIIIaV |
| M103205H795-SG1 | 4.7E−06 | 6.2E−07 | 1.0 | 1.0 | 1.0 | 1.0 | 1.00 | 1.0 | 1.0 | 1.0 | 1.00 |
| M103205H795-MY201 | 8.5E−07 | 3.7E−05 | 3.2 | 4.0 | 4.9 | 5.8 | 0.08 | 0.9 | 0.8 | 5.6 | 0.02 |

TABLE 27-continued

| | | | | | | | | | | | |
|---|---|---|---|---|---|---|---|---|---|---|---|
| M103205H795-MY351 | 9.7E−07 | 7.4E−06 | 3.0 | 3.6 | 4.0 | 5.0 | 0.07 | 0.7 | 0.8 | 4.7 | 0.08 |
| M103205H795-MY352 | 1.0E−06 | 1.1E−05 | 2.7 | 3.5 | 3.9 | 4.7 | 0.07 | 0.7 | 0.6 | 4.6 | 0.06 |
| M103205H795-PY55 | 7.6E−07 | 1.3E−05 | 3.5 | 4.1 | 4.3 | 5.4 | 0.08 | 1.1 | 0.7 | 6.3 | 0.05 |
| M103205H795-PY56 | 1.0E−06 | 1.0E−05 | 2.6 | 3.9 | 3.5 | 3.9 | 0.06 | 0.8 | 0.5 | 4.7 | 0.06 |
| M103205H795-PY57 | 1.2E−06 | 2.3E−05 | 2.3 | 2.0 | 2.7 | 3.8 | 0.06 | 0.7 | 0.5 | 4.1 | 0.03 |

Preparation and Profile of Tested Variants

The tested 7 antibodies and their binding profiles are summarized in Table 27. The heavy chain, MS103205H795-MY352, MS103205H795-PK55, MS103205H795-PK56, MS103205H795-PK57, were prepared by introducing pI-increasing substitutions Q311R/D413R, Q311R/P343R, Q311R/P343R/D413R, Q311R/N384R/D413R, respectively, into MS103205H795-MY201. All the MS1032LO06 variants were expressed with M103202L889-SK1 as light chain according to the method shown in Example 34 and their affinities to human and cynoFcγRs were evaluated using the method in Example 27.

Based on the SPR analysis summarized in Table 27, it was confirmed that the pI-increasing substitutions do not affect the FcγR binding of FcγRIIb-enhanced Fc variants. MY201 and MY351, which was prepared by introducing Q311R/D413K into MY201, show 6-fold and 5-fold enhanced human FcγRIIb binding, respectively. With respect to other human and cynoFcγRs, they show almost the same binding profile. Similarly, MY352, PK55, PK56 and PK57 showed similar binding profile with parent MY201 (Table 27). These results indicates that either pair of pI-increasing substitutions does not affect the affinities against human and cynoFcγRs.

PK Study in Human FcγRIIb Transgenic Mice

In Vivo Test Using Human FcγRIIb Transgenic Mice

The elimination of myostatin and anti-latent myostatin antibody were assessed in vivo upon co-administration of anti-latent myostatin antibody and human latent myostatin in human FcγRIIb transgenic mice in which mouse FcγRII was substituted with human FcγRIIb. An anti-latent myostatin antibody (0.3 mg/ml) and latent myostatin (0.05 mg/ml) were administered at a single dose of 10 ml/kg into the caudal vein. Blood was collected at 5 minutes, 1 hour, 4 hours, 7 hours, 1 day, 7 days, 14 days, 21 days, and 28 days after administration. The collected blood was centrifuged immediately at 15,000 rpm in 4° C. for 5 minutes to separate the plasma. The separated plasma was stored at or below −20° C. until measurement. The anti-latent myostatin antibodies used were MS1032LO06-SG1, MS1032LO06-MY201, MS1032LO06-MY351, MS1032LO06-MY352, MS1032LO06-PK55, MS1032LO06-PK56 and MS1032LO06-PK57.

Measurement of Total Myostatin Concentration in Plasma by Electrochemiluminescence The concentration of total myostatin in mouse plasma was measured by electrochemiluminescence (ECL) as described in Example 28. The time course of total myostatin concentration in plasma after intravenous administration of anti-latent myostatin antibody and latent myostatin measured by this method is shown in FIG. 29.

Measurement of Anti-Latent Myostatin Antibody Concentration in Plasma by Enzyme-Linked Immunosorbent Assay (ELISA)

The concentration of anti-latent myostatin antibody in mouse plasma was measured by ELISA. Anti-human IgG (γ-chain specific) F(ab')2 antibody fragment (Sigma) was dispensed onto a Nunc-ImmunoPlate MAXISORP™ (Nalge Nunc International) and allowed to stand overnight at 4° C. to prepare anti-human IgG-immobilized plates. Calibration curve samples having plasma concentrations of 2.5, 1.25, 0.625, 0.313, 0.156, 0.078, and 0.039 μg/ml, and mouse plasma samples diluted 100-fold or more were prepared. Then, the samples were dispensed onto the anti-human IgG-immobilized plates, and allowed to stand for 1 hour at room temperature. Subsequently, Goat Anti-Human IgG (γ-chain specific) Biotin conjugate (Southern Biotech) was added to react for 1 hour at room temperature. Then, Streptavidin-PolyHRP80 (Stereospecific Detection Technologies) was added to react for one hour at room temperature, and chromogenic reaction was carried out using TMB One Component HRP Microwell Substrate (BioFX Laboratories) as a substrate. After stopping the reaction with 1 N sulfuric acid (Showa Chemical), the absorbance at 450 nm was measured by a microplate reader. The concentration in mouse plasma was calculated from the absorbance of the calibration curve using the analytical software SOFTMAX® PRO (Molecular Devices). The time course of antibody concentration in plasma after intravenous administration of anti-latent myostatin antibody and latent myostatin measured by this method is shown in FIG. 30.

Effect of pI and FcγR Binding on Myostatin Concentration In Vivo

After administration of MS1032LO06-MY201, plasma total myostatin concentration at 7 hours decreased 8 fold compared to plasma total myostatin concentration at 5 minutes. In contrast, after administration of MS1032LO06-PK57, plasma total myostatin concentration at 7 hours decreased 376 fold compared to plasma total myostatin concentration at 5 minutes. Other high pI variants showed similar enhancement of myostatin elimination from plasma. Antibody concentration of high pI variants at 28 days decreased 2-3 fold compared to antibody concentration of MS1032LO06-SG1, and pI variants showed slight enhancement of antibody elimination from plasma.

High pI variants have more positive charge in plasma. Since this positive charge interacts with cell surface of negative charge, antigen-antibody immune complex of high pI variants get closer to cell surface, resulted in increased cellular uptake of antigen-antibody immune complex of high pI variants.

Example 32

Development of Human FcγRIIb-Enhanced Fc Variants

Human FcγRIIb-enhanced Fc variants with anti-myostatin variable region were constructed and their affinity for human FcγRs was evaluated. Specifically, human FcγRIIb-enhanced Fc variants were constructed by introducing substitutions into MS103240H795-SG1 (VH, SEQ ID NO: 92; CH, SEQ ID NO: 9) in combination with T250V/T307P substitutions. In addition, substitutions (Q311R/D413K or Q311R/P343R) were also introduced. The variants were expressed using M103202L1045-SK1 as light chain and their affinity to human FcγRs was analyzed according to the method shown in Example 34. Table 28 shows the result of kinetic analysis against human and cynoFcγRs. The KD values in cells filled in gray were calculated using [Equation 2]since their affinity was too weak to be correctly determined by kinetic analysis.

All the variants evaluated showed enhanced affinity to human FcγRIIb and reduced binding to human FcγRIIaR, FcγRIIaH, FcγRIIIaV compared to SG1. The affinity to human FcγRIIb varies between 4.1-fold and 30.5-fold increase compared to SG1. The affinity to human FcγRIIaR was between 0.02-fold and 0.22-fold. The affinities to human FcγRIIaH and human FcγRIIIaV were less than 0.04-fold and 0.012-fold, respectively. It was revealed that the substitutions (T250V/T307P) does not affect the binding profile to human FcγRs by comparing the affinities of MY009 (P238D) and MY214 (P238D/T250V/T307P). On the other hand, both pair of pI-increasing substitutions (Q311R/D413K and Q311R/P343R) decreased the binding affinity about 0.5-fold compared to the variants which does not contain the pI-increasing substitutions. For example, although TT14 showed 30.5-fold higher affinity to human FcγRIIb, it showed only 16.1-fold and 14.5-fold increase in combination with Q311R/D413K (TT33) and Q311R/P343R (TT32), respectively.

Furthermore, the substitutions used in Example 29 for improving antibody half-life and reducing binding to rheumatoid factor were introduced into human FcγRIIb-enhanced Fc variants and their affinity against human FcγRs were analyzed (Table 29). In this SPR analysis, all the data were obtained using mouse anti-human IgG kappa light chain for capturing the antibodies of interest. Table 30 shows the result and the KD values in cells filled in gray were calculated using [Equation 2] since their affinity was too weak to be correctly determined by kinetic analysis.

SG1 and TT33 were evaluated again in this measurement in which capturing method was different from that in Table 28. As a result, "KD fold" values of TT33 were consistent with those obtained with Table 28 (16.1-fold in Table 28 and 15.7-fold in Table 30 against human FcγRIIb). TT92 and TT93, which were constructed by introducing N434A/Q438R/S440E and M428L/N434A/Y436T/Q438R/S440E into TT33, showed comparable binding profile to TT33. Similarly, TT90 and TT91 derived from TT32, TT72 and TT73 derived from TT31, TT70 and TT71 derived from TT30, TT68 and TT69 derived from TT21, and TT66 and TT67 derived from TT20 show comparable binding profile to those of parental antibodies shown in Table 28. These results indicate that substitutions for improving antibody half-life and reducing binding to rheumatoid factor do not affect binding profile of human FcγRIIb-enhanced variants against human FcγRs.

Example 33

Cell Imaging Analysis of FcγRIIb-Enhanced Fc Variants

To evaluate the intracellular uptake of antigen-antibody complex formed by the antibody described in Example 32, cell imaging assay described in Example 30 was performed. To avoid the signal saturation, the antigen-antibody complexes were formed in a culture solution with the antibody concentration being 1.25 mg/mL and the antigen concentration being 0.34 mg/mL in this example.

Assay results are shown in FIG. 31. By increasing the binding affinity to human FcγRIIb, cellular uptake of antigen-antibody complex were increased. In case of TT14, which has 30 fold enhanced binding affinity to human FcγRIIb compared with SG1, the antigen florescent intensity inside cells was 7.5 fold increased as that of SG1.

Although pI-increasing substitutions (Q311R/D413K and Q311R/P343R) decreased the binding affinity to human FcγRIIb about 0.5-fold compared to the variants

TABLE 28

Binding profile of the human FcγRIIb-enhanced Fc variant

| Heavy chain name | CH | SEQ ID NO | Substitutions |
| --- | --- | --- | --- |
| MS103240H795-SG1 | SG1 | 9 | — |
| MS103240H795-MY009 | MY009 | 252 | P238D |
| MS103240H795-MY214 | MY214 | 253 | P238D/T250V/T307P |
| MS103240H795-TT08 | TT08 | 254 | P238D/T250V/T307P/A330K |
| MS103240H795-TT09 | TT09 | 255 | P238D/T250V/V264I/T307P/A330K |
| MS103240H795-TT10 | TT10 | 256 | P238D/T250V/S267A/T307P/A330K |
| MS103240H795-TT11 | TT11 | 257 | L234Y/P238D/T250V/T307P/A330K |
| MS103240H795-TT12 | TT12 | 258 | L234Y/P238D/T250V/S267A/T307P/A330K |
| MS103240H795-TT13 | TT13 | 259 | P238D/T250V/V264I/S267A/T307P/A330K |
| MS103240H795-TT14 | TT14 | 260 | L234Y/P238D/T250V/V264I/T307P/A330K |
| MS103240H795-TT15 | TT15 | 261 | L234Y/P238D/T250V/V264I/S267A/T307P/A330K |
| MS103240H795-TT20 | TT20 | 262 | P238D/T250V/T307P/Q311R/A330K/P343R |
| MS103240H795-TT21 | TT21 | 263 | P238D/T250V/T307P/Q311R/A330K/D413K |
| MS103240H795-TT22 | TT22 | 264 | P238D/T250V/V264I/T307P/Q311R/A330K/P343R |
| MS103240H795-TT23 | TT23 | 265 | P238D/T250V/V264I/T307P/Q311R/A330K/D413K |
| MS103240H795-TT24 | TT24 | 266 | P238D/T250V/S267A/T307P/Q311R/A330K/P343R |
| MS103240H795-TT25 | TT25 | 267 | P238D/T250V/S267A/T307P/Q311R/A330K/D413K |
| MS103240H795-TT26 | TT26 | 268 | L234Y/P238D/T250V/T307P/Q311R/A330K/P343R |
| MS103240H795-TT27 | TT27 | 269 | L234Y/P238D/T250V/T307P/Q311R/A330K/D413K |
| MS103240H795-TT28 | TT28 | 270 | L234Y/P238D/T250V/S267A/T307P/Q311R/A330K/P343R |
| MS103240H795-TT29 | TT29 | 271 | L234Y/P238D/T250V/S267A/T307P/Q311R/A330K/D413K |
| MS103240H795-TT30 | TT30 | 272 | P238D/T250V/V264I/S267A/T307P/Q311R/A330K/P343R |
| MS103240H795-TT31 | TT31 | 273 | P238D/T250V/V264I/S267A/T307P/Q311R/A330K/D413K |
| MS103240H795-TT32 | TT32 | 274 | L234Y/P238D/T250V/V264I/T307P/Q311R/A330K/P343R |
| MS103240H795-TT33 | TT33 | 275 | L234Y/P238D/T250V/V264I/T307P/Q311R/A330K/D413K |
| MS103240H795-TT34 | TT34 | 276 | L234Y/P238D/T250V/V264I/S267A/T307P/Q311R/A330K/P343R |
| MS103240H795-TT35 | TT35 | 277 | L234Y/P238D/T250V/V264I/S267A/T307P/Q311R/A330K/D413K |

TABLE 28-continued

Binding profile of the human FcγRIIb-enhanced Fc variant

| Heavy chain name | KD (M) for humanFcgRs | | | | KD fold for humanFcgRs (SG1 = 1) | | | |
|---|---|---|---|---|---|---|---|---|
| | FcgRIIaH | FcgRIIaR | FcgRIIb | FcgRIIIaV | FcgRIIaH | FcgRIIaR | FcgRIIb | FcgRIIIaV |
| MS103240H795-SG1 | 7.5E−07 | 1.1E−06 | 5.8E−06 | 8.1E−07 | 1.000 | 1.00 | 1.0 | 1.000 |
| MS103240H795-MY009 | 7.3E−05 | 2.3E−05 | 1.3E−06 | 2.2E−04 | 0.010 | 0.05 | 4.5 | 0.004 |
| MS103240H795-MY214 | 3.2E−05 | 2.1E−05 | 1.0E−06 | 1.5E−04 | 0.023 | 0.05 | 5.8 | 0.005 |
| MS103240H795-TT08 | 5.5E−05 | 1.6E−05 | 6.8E−07 | 9.6E−05 | 0.014 | 0.07 | 8.5 | 0.008 |
| MS103240H795-TT09 | 4.4E−05 | 1.4E−05 | 2.9E−07 | 1.7E−04 | 0.017 | 0.08 | 20.0 | 0.005 |
| MS103240H795-TT10 | 5.6E−05 | 8.7E−06 | 6.3E−07 | 7.9E−04 | 0.013 | 0.13 | 9.2 | 0.001 |
| MS103240H795-TT11 | 2.4E−05 | 1.0E−05 | 5.2E−07 | 1.7E−04 | 0.031 | 0.11 | 11.2 | 0.005 |
| MS103240H795-TT12 | 2.0E−05 | 5.0E−06 | 4.9E−07 | 1.3E−04 | 0.038 | 0.22 | 11.8 | 0.006 |
| MS103240H795-TT13 | 4.5E−05 | 9.8E−06 | 3.2E−07 | 1.4E−04 | 0.017 | 0.11 | 18.1 | 0.006 |
| MS103240H795-TT14 | 1.8E−05 | 7.6E−06 | 1.9E−07 | 1.5E−04 | 0.042 | 0.14 | 30.5 | 0.005 |
| MS103240H795-TT15 | 2.9E−05 | 6.1E−06 | 2.5E−07 | 1.3E−04 | 0.026 | 0.18 | 23.2 | 0.006 |
| MS103240H795-TT20 | 9.1E−05 | 2.8E−05 | 1.4E−06 | 8.4E−05 | 0.008 | 0.04 | 4.1 | 0.010 |
| MS103240H795-TT21 | 5.6E−05 | 2.0E−05 | 1.3E−06 | 8.5E−05 | 0.013 | 0.06 | 4.5 | 0.010 |
| MS103240H795-TT22 | 6.0E−05 | 2.1E−05 | 5.9E−07 | 7.2E−05 | 0.013 | 0.05 | 9.8 | 0.011 |
| MS103240H795-TT23 | 1.0E−04 | 4.8E−05 | 5.5E−07 | 4.5E−04 | 0.007 | 0.02 | 10.5 | 0.002 |
| MS103240H795-TT24 | 4.9E−05 | 1.3E−05 | 1.2E−06 | 2.6E−04 | 0.015 | 0.08 | 4.8 | 0.003 |
| MS103240H795-TT25 | 2.2E−05 | 1.3E−05 | 1.0E−06 | 1.4E−04 | 0.034 | 0.08 | 5.8 | 0.006 |
| MS103240H795-TT26 | 6.9E−05 | 2.1E−05 | 1.1E−06 | 2.0E−04 | 0.011 | 0.05 | 5.3 | 0.004 |
| MS103240H795-TT27 | 5.2E−05 | 1.4E−05 | 8.2E−07 | 1.3E−04 | 0.014 | 0.08 | 7.1 | 0.006 |
| MS103240H795-TT28 | 4.8E−05 | 7.7E−06 | 8.5E−07 | 8.2E−05 | 0.016 | 0.14 | 6.8 | 0.010 |
| MS103240H795-TT29 | 3.7E−05 | 7.5E−06 | 8.1E−07 | 8.9E−05 | 0.020 | 0.15 | 7.2 | 0.009 |
| MS103240H795-TT30 | 1.5E−04 | 1.4E−05 | 5.7E−07 | 6.6E−05 | 0.005 | 0.08 | 10.2 | 0.012 |
| MS103240H795-TT31 | 1.1E−04 | 1.9E−05 | 5.6E−07 | 2.9E−04 | 0.007 | 0.06 | 10.4 | 0.003 |
| MS103240H795-TT32 | 5.0E−05 | 1.2E−05 | 4.0E−07 | 1.1E−04 | 0.015 | 0.09 | 14.5 | 0.007 |
| MS103240H795-TT33 | 4.2E−05 | 1.2E−05 | 3.6E−07 | 4.4E−04 | 0.018 | 0.09 | 16.1 | 0.002 |
| MS103240H795-TT34 | 2.2E−05 | 8.9E−06 | 4.9E−07 | 9.6E−05 | 0.034 | 0.12 | 11.8 | 0.008 |
| MS103240H795-TT35 | 2.5E−05 | 9.0E−06 | 4.3E−07 | 1.8E−04 | 0.030 | 0.12 | 13.5 | 0.004 |

TABLE 29

Amino acid sequences of heavy chain constant regions comprising human FcγRIIb-enhanced Fc variants (shown as SEQ ID NOs)

| CH | — | +N434A +Q438R +S440E | +N434A +Y436T +Q438R +S440E | +M428L +N434A +Y436T +Q438R +S440E | +M428L +N434A +Q438R +S440E |
|---|---|---|---|---|---|
| MY009 | 252 | 278 | 304 | 330 | 356 |
| MY214 | 253 | 279 | 305 | 331 | 357 |
| TT08 | 254 | 280 | 306 | 332 | 358 |
| TT09 | 255 | 281 | 307 | 333 | 359 |
| TT10 | 256 | 282 | 308 | 334 | 360 |
| TT11 | 257 | 283 | 309 | 335 | 361 |
| TT12 | 258 | 284 | 310 | 336 | 362 |
| TT13 | 259 | 285 | 311 | 337 | 363 |
| TT14 | 260 | 286 | 312 | 338 | 364 |
| TT15 | 261 | 287 | 313 | 339 | 365 |
| TT20 | 262 | 288 | 314 | 340 | 366 |
| TT21 | 263 | 289 | 315 | 341 | 367 |
| TT22 | 264 | 290 | 316 | 342 | 368 |
| TT23 | 265 | 291 | 317 | 343 | 369 |
| TT24 | 266 | 292 | 318 | 344 | 370 |
| TT25 | 267 | 293 | 319 | 345 | 371 |
| TT26 | 268 | 294 | 320 | 346 | 372 |
| TT27 | 269 | 295 | 321 | 347 | 373 |
| TT28 | 270 | 296 | 322 | 348 | 374 |
| TT29 | 271 | 297 | 323 | 349 | 375 |
| TT30 | 272 | 298 | 324 | 350 | 376 |
| TT31 | 273 | 299 | 325 | 351 | 377 |
| TT32 | 274 | 300 | 326 | 352 | 378 |
| TT33 | 275 | 301 | 327 | 353 | 379 |
| TT34 | 276 | 302 | 328 | 354 | 380 |
| TT35 | 277 | 303 | 329 | 355 | 381 |

TABLE 30

Binding profile of the human FcγRIIb-enhanced Fc variants

| Heavy chain name | CH | SEQ ID NO | Substitutions |
|---|---|---|---|
| MS103240H795-SG1 | SG1 | 9 | — |
| MS103240H795-TT33 | TT33 | 275 | L234Y/P238D/T250V/V264I/T307P/Q311R/A330K/D413K |
| MS103240H795-TT66 | TT66 | 288 | P238D/T250V/T307P/Q311R/A330K/P343R/N434A/Q436R/S440E |
| MS103240H795-TT67 | TT67 | 340 | P238D/T250V/T307P/Q311R/A330K/P343R/M428L/N434A/Y436T/Q438R/S440E |
| MS103240H795-TT68 | TT68 | 289 | P238D/T250V/T307P/Q311R/A330K/D413K/N434A/Q438R/S440E |
| MS103240H795-TT69 | TT69 | 341 | P238D/T250V/T307P/Q311R/A330K/M428L/N434A/Y436T/Q438R/S440E |
| MS103240H795-TT70 | TT70 | 290 | P238D/T250V/V264I/T307P/Q311R/A330K/P343R/N434A/Q438R/S440E |
| MS103240H795-TT71 | TT71 | 342 | P238D/T250V/V264I/T307P/Q311R/A330K/P343R/M428L/N434A/Y436T/Q438R/S440E |
| MS103240H795-TT72 | TT72 | 291 | P238D/T250V/V264I/T307P/Q311R/A330K/D413K/N434A/Q438R/S440E |

TABLE 30-continued

Binding profile of the human FcγRIIb-enhanced Fc variants

| | | | |
|---|---|---|---|
| MS103240H795-TT73 | TT73 | 343 | P238D/T250V/V264I/T307P/Q311R/A330K/D413K/M428L/N434A/Y436T/Q438R/S440E |
| MS103240H795-TT90 | TT90 | 300 | L234Y/P238D/T250V/V264I/T307P/Q311R/A330K/P343R/N434A/Q438R/S440E |
| MS103240H795-TT91 | TT91 | 352 | L234Y/P238D/T250V/V264I/T307P/Q311R/A330K/P343R/M428L/N434A/Y436T/Q438R/S440E |
| MS103240H795-TT92 | TT92 | 301 | L234Y/P238D/T250V/V264I/T307P/Q311R/A330K/D413K/N434A/Q438R/S440E |
| MS103240H795-TT93 | TT93 | 353 | L234Y/P238D/T250V/V264I/T307P/Q311R/A330K/D413K/M428L/N434A/Y436T/Q438R/S440E |

| | KD (M) for humanFcgRs | | | | KD fold for humanFcgRs (SG1 = 1) | | | |
|---|---|---|---|---|---|---|---|---|
| Heavy chain name | FcgRIIaH | FcgRIIaR | FcgRIIb | FcgRIIIaV | FcgRIIaH | FcgRIIaR | FcgRIIb | FcgRIIIaV |
| MS103240H795-SG1 | 9.7E−07 | 1.2E−06 | 4.7E−06 | 7.2E−07 | 1.000 | 1.00 | 1.0 | 1.000 |
| MS103240H795-TT33 | 3.5E−05 | 2.3E−05 | 3.0E−07 | 4.0E−04 | 0.028 | 0.05 | 15.7 | 0.002 |
| MS103240H795-TT66 | 1.3E−04 | 3.2E−05 | 1.0E−06 | 5.9E−04 | 0.007 | 0.04 | 4.7 | 0.001 |
| MS103240H795-TT67 | 1.2E−04 | 2.8E−05 | 1.2E−06 | 6.1E−04 | 0.008 | 0.04 | 3.9 | 0.001 |
| MS103240H795-TT68 | 2.1E−04 | 6.1E−05 | 9.6E−07 | 4.8E−04 | 0.006 | 0.02 | 4.9 | 0.001 |
| MS103240H795-TT69 | 1.3E−04 | 3.4E−05 | 1.1E−06 | 9.3E−04 | 0.008 | 0.04 | 4.3 | 0.001 |
| MS103240H795-TT70 | 7.2E−05 | 4.0E−05 | 3.7E−07 | 3.9E−04 | 0.013 | 0.03 | 12.7 | 0.002 |
| MS103240H795-TT71 | 9.6E−05 | 2.7E−05 | 4.2E−07 | 4.0E−04 | 0.010 | 0.04 | 11.2 | 0.002 |
| MS103240H795-TT72 | 7.9E−05 | 2.4E−05 | 4.0E−07 | 9.0E−04 | 0.012 | 0.05 | 11.8 | 0.001 |
| MS103240H795-TT73 | 7.4E−05 | 1.9E−05 | 4.2E−07 | 5.6E−04 | 0.013 | 0.06 | 11.2 | 0.001 |
| MS103240H795-TT90 | 2.9E−05 | 2.5E−05 | 3.0E−07 | 9.6E−04 | 0.033 | 0.05 | 15.7 | 0.002 |
| MS103240H795-TT91 | 4.6E−05 | 3.0E−05 | 3.2E−07 | 4.5E−04 | 0.020 | 0.04 | 14.7 | 0.002 |
| MS103240H795-TT92 | 4.0E−05 | 2.0E−05 | 2.8E−07 | 4.9E−04 | 0.024 | 0.06 | 16.8 | 0.001 |
| MS103240H795-TT93 | 5.2E−05 | 2.4E−05 | 3.1E−07 | 4.7E−04 | 0.019 | 0.05 | 15.2 | 0.002 | which do not contain the pI-increasing substitutions, the cellular uptake of antigen antibody complex of Fc variants with pI increased substitutions was increased compared to Fc variants without pI increased substitutions. TT33 shows 36 fold increase in antigen antibody uptake into the cells compared to SG1, while its parent TT14 shows 7.5 fold increase in cellular uptake. Furthermore, TT33 shows comparable cellular uptake of antigen-antibody complex into the cells compared to SG1071, SG1074, SG1077, SG1079, SG1080 and SG1081 which shows strong sweeping in Cynomolugus monkey. These results suggest that combining of pI increased substitutions with FcγRIIb enhanced Fc variants is the powerful tool for antigen sweeping.

Example 34

Construction of Antibody Expression Vectors; and Expression and Purification of Antibodies Synthesis of full-length genes encoding the nucleotide sequences of the H chain and L chain of the antibody variable regions was carried out by production methods known to those skilled in the art using Assemble PCR and such. Introduction of amino acid substitutions was carried out by methods known to those skilled in the art using PCR or such. The obtained plasmid fragment was inserted into an animal cell expression vector, and the H-chain expression vector and L-chain expression vector were produced. The nucleotide sequence of the obtained expression vector was determined by methods known to those skilled in the art. The produced plasmids were introduced transiently into the HEK293H cell line derived from human embryonic kidney cancer cells (Invitrogen) or into FREESTYLE™ 293 cells (Invitrogen) for antibody expression. The obtained culture supernatant was collected, and then passed through a 0.22 μm MILLEX(R)-GV filter (Millipore), or through a 0.45 μm MILLEX(R)-GV filter (Millipore) to obtain the culture supernatant. Antibodies were purified from the obtained culture supernatant by methods known to those skilled in the art using rProtein A Sepharose Fast Flow (GE Healthcare) or Protein G Sepharose 4 Fast Flow (GE Healthcare). For the concentration of the purified antibodies, their absorbance at 280 nm was measured using a spectrophotometer. From the obtained value, the extinction coefficient calculated by the methods such as PACE was used to calculate the antibody concentration (*Protein Sci.* 4:2411-2423 (1995)).

Although the foregoing invention has been described in some detail by way of illustration and example for purposes of clarity of understanding, the descriptions and examples should not be construed as limiting the scope of the invention. The disclosures of all patent and scientific literature cited herein are expressly incorporated in their entirety by reference.

SEQUENCE LISTING (383 sequences)

SEQ ID NO: 1 - protein, 375 aa, Homo sapiens
MQKLQLCVYIYLFMLIVAGPVDLNENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 2 - protein, 109 aa, Homo sapiens
DFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 3 - protein, 375 aa, Artificial Sequence
  cynomolgous monkey  myostatin (promyostatin)
MQKLQLCVYIYLFMLIVAGPVDLNENSEQKENVEKEGLCNACTWRQNTKSSRIEAIKIQILSKLRLETAPNISKDAIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 4 - protein, 109 aa, artificial sequence; identical to SEQ ID NO: 2
  cynomolgous monkey myostatin mature form

SEQ ID NO: 5 - protein, 376 aa, mus musculus
MMQKLQMYVYIYLFMLIAAGPVDLNEGSEREENVEKEGLCNACAWRQNTRYSRIEAIKIQILSKLRLETAPNISKDAIRQLLPRAPPLRELIDQYDVQRDDSSDGSLEDDDYHATTETIITMPTESDFLMQADGKPKCCFFKFSSKIQYNKVVKAQLWIYLRPVKTPTTVFVQILRLIKPMKDGTRYTGIRSLKLDMSPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 6 - protein, 109 aa, mus musculus; identical to SEQ ID NO: 2

SEQ ID NO: 7 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 8 - protein, 107 aa, Homo sapiens
RTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 9 - protein, 328 aa, Homo sapiens; identical to SEQ ID NO: 7

SEQ ID NO: 10 - protein, 107 aa, Homo sapiens [sequence omitted]

SEQ ID NO: 11 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 12 - protein, 116 aa, Oryctolagus Cuniculus
QSLEESGGRLVTPGGSLTVTCRVSGIDLSSYDISWVRQAPGKGLEWIGIISYAGSTYYASWAKGRFTISKTSTTVDLKMTSLTTEDTATYFCARGVPAYSTGGDLWGPGTLVTVSS

SEQ ID NO: 13 - protein, 119 aa, artificial sequence
  synthetic humanized sequence- MS1032LO00 VH
QVTLKESGPVLVKPTETLTLTCTVSGIDLSSYDISWVRQAPGKGLEWVGIISYAGSTYYASWAKGRLTISKDTSKNQVVLTMTNMDPVDTATYYCARGVPAYSTGGDLWGQGTLVTVSS

SEQ ID NO: 14 - protein, 110 aa, Oryctolagus Cuniculus
AQVLTQTASSVSAAVGGTVTINCQSSQSVYDNNWLSWFQQKPGQPPKLLIYWASTLASGVPSRFKGSGSGTQFTLTISDLECDDAATYYCAGGYGGGLYAFGGGTKVEIK

SEQ ID NO: 15 - protein, 110 aa, artificial sequence
  synthetic humanized sequence-MS1032LO00 VL
DIVMTQSPATLSLSPGERATLSCQSSQSVYDNNWLSWFQQKPGQPPKLLIYWASTLASGVPSRFSGSGSGTDFTLTISSLQPEDAATYYCAGGYGGGLYAFGQGTKVEIK

SEQ ID NO: 16 - protein, 119 aa, Homo sapiens
QVTLKESGPVLVKPTETLTLTCTVSGIDLSHYDISWVRQAPGKGLEWVGIISYAGSTYYASWAKGRLTISKDTSKNQVVLTMTNMDPVDTATYYCARGVPAYSTGGDLWGQGTLVTVSS

SEQ ID NO: 17 - protein, 119 aa, Homo sapiens
QVTLKESGPVLVKPTETLTLTCTVSGIDLSSYDISWVRQAPGKGLEWVGIISHAGSTYYASWAKGRLTISKDTSKNQVVLTMTNMDPVDTATYYCARGVPAYSTGGDLWGQGTLVTVSS

SEQ ID NO: 18 - protein, 119 aa, Homo sapiens
QVTLKESGPVLVKPTETLTLTCTVSGIDLSSYDISWVRQAPGKGLEWVGIISYAGSTYYASWAKGRLTISKDTSKNQVVLTMTNMDPVDTATYYCARGVPAHSTGGDLWGQGTLVTVSS

SEQ ID NO: 19 - protein, 119 aa, Homo sapiens
QVTLKESGPVLVKPTETLTLTCTVSGIDLSSYDISWVRQAPGKGLEWVGIISYAGSTYYASWAKGRLTISKDTSKNQVVLTMTNMDPVDTATYYCARGVPAYSHGGDLWGQGTLVTVSS

SEQ ID NO: 20 - protein, 119 aa, Homo sapiens
QVTLKESGPVLVKPTETLTLTCTVSGIDLSHYDISWVRQAPGKGLEWVGIISHAGSTYYASWAKGRLTISKDTSKNQVVLTMTNMDPVDTATYYCARGVPAYSTGGDLWGQGTLVTVSS

SEQ ID NO: 21 - protein, 119 aa, Homo sapiens
QVTLKESGPVLVKPTETLTLTCTVSGIDLSSYDISWVRQAPGKGLEWVGIISHAGSTYYASWAKGRLTISKDTSKNQVVLTMTNMDPVDTATYYCARGVPAHSTGGDLWGQGTLVTVSS

SEQ ID NO: 22 - protein, 119 aa, Homo sapiens
QVTLKESGPVLVKPTETLTLTCTVSGIDLSHYDISWVRQAPGKGLEWVGIISYAGSTYYASWAKGRLTISKDTSKNQVVLTMTNMDPVDTATYYCARGVPAHSTGGDLWGQGTLVTVSS

SEQ ID NO: 23 - protein, 119 aa, Homo sapiens
QVTLKESGPVLVKPTETLTLTCTVSGIDLSHYDISWVRQAPGKGLEWVGIISHAGSTYYASWAKGRLTISKDTSKNQVVLTMTNMDPVDTATYYCARGVPAHSTGGDLWGQGTLVTVSS

SEQ ID NO: 24 - protein, 119 aa, Homo sapiens
QVTLKESGPVLVKPTETLTLTCTVSGIDLSHYDISWVRQAPGKGLEWVGIISYAGSTYYASWAKGRLTISKDTSKNQVVLTMTNMDPVDTATYYCARGVPAYSHGGDLWGQGTLVTVSS

SEQ ID NO: 25 - protein, 119 aa, Homo sapiens
QVTLKESGPVLVKPTETLTLTCTVSGIDLSSYDISWVRQAPGKGLEWVGIISHAGSTYYASWAKGRLTISKDTSKNQVVLTMTNMDPVDTATYYCARGVPAYSHGGDLWGQGTLVTVSS

SEQ ID NO: 26 - protein, 119 aa, Homo sapiens
QVTLKESGPVLVKPTETLTLTCTVSGIDLSSYDISWVRQAPGKGLEWVGIISYAGSTYYASWAKGRLTISKDTSKNQVVLTMTNMDPVDTATYYCARGVPAHSHGGDLWGQGTLVTVSS

SEQ ID NO: 27 - protein, 119 aa, Homo sapiens
QVTLKESGPVLVKPTETLTLTCTVSGIDLSHYDISWVRQAPGKGLEWVGIISHAGSTYYASWAKGRLTISKDTSKNQVVLTMTNMDPVDTATYYCARGVPAYSHGGDLWGQGTLVTVSS

SEQ ID NO: 28 - protein, 119 aa, Homo sapiens
QVTLKESGPVLVKPTETLTLTCTVSGIDLSSYDISWVRQAPGKGLEWVGIISHAGSTYYASWAKGRLTISKDTSKNQVVLTMTNMDPVDTATYYCARGVPAHSHGGDLWGQGTLVTVSS

SEQ ID NO: 29 - protein, 119 aa, Homo sapiens
QVTLKESGPVLVKPTETLTLTCTVSGIDLSHYDISWVRQAPGKGLEWVGIISYAGSTYYASWAKGRLTISKDTSKNQVVLTMTNMDPVDTATYYCARGVPAHSHGGDLWGQGTLVTVSS

SEQ ID NO: 30 - protein, 119 aa, Homo sapiens
QVTLKESGPVLVKPTETLTLTCTVSGIDLSHYDISWVRQAPGKGLEWVGIISHAGSTYYASWAKGRLTISKDTSKNQVVLTMTNMDPVDTATYYCARGVPAHSHGGDLWGQGTLVTVSS

SEQ ID NO: 31 - protein, 110 aa, artificial sequence
  synthetic humanized sequence-MS103202L008 VL
DIVMTQSPATLSLSPGERATLSCQSSQSVYHNNWLSWFQQKPGQPPKLLIYWASTLASGVPSRFSGSGSGTDFTLTISSLQPEDAATYYCAGGYGGGLYAFGQGTKVEIK

SEQ ID NO: 32 - protein, 119 aa, artificial sequence
  synthetic humanized sequence- MS1032LO01 VH
QVTLKESGPVLVKPTETLTLTCTVSGIDLSHTDISWVRQAPGKGLEWVGIISYAGSTYYASWAKGRLTISKDTSKNQVVLTMTNMDPVDTATYYCARGVPAYSHGGDLWGQGTLVTVSS

SEQ ID NO: 33 - protein, 119 aa, artificial sequence
  synthetic humanized sequence-MS1032LO02, 03 VH
QVTLKESGPVLVKPTETLTLTCTVSGIDLSHTDISWVRQAPGKGLEWVGIISYAGSTYYMSWAKGRLTISKDTSKNQVVLTMTNMDPVDTATYYCARGVPAYSHGGDLWGQGTLVTVSS

SEQ ID NO: 34 - protein, 119 aa, artificial sequence; identical to SEQ ID NO: 24
  synthetic humanized sequence-MS1032LO04 VH

SEQ ID NO: 35 - protein, 110 aa, artificial sequence
  synthetic humanized sequence-MS1032LO01 VL
DIVMTQSPATLSLSPGERATLSCTSSQSVYHNNWLSWFQQKPGQPPKLLIYWASTLAYGVPSRFSGSGSGTDFTLTISSLQPEDAATYYCAGGYGGGRYAFGQGTKVEIK

SEQ ID NO: 36 - protein, 110 aa, artificial sequence
  synthetic humanized sequence-MS1032LO02 VL
DIVMTQSPATLSLSPGERATLSCQSSQSVYHNNWLSWFQQKPGQPPKLLIYWASTLAFGVPSRFSGSGSGTDFTLTISSLQPEDAATYYCAGGYGGGLYAFGQGTKVEIK

SEQ ID NO: 37 - protein, 110 aa, artificial sequence
  synthetic humanized sequence-MS1032LO03 VL
DIVMTQSPATLSLSPGERATLSCQTSQSVYHDNWLSWFQQKPGQPPKLLIYWASTLASGVPSRFSGSGSGTDFTLTISSLQPEDAATYYCAGGYGGGRYAFGQGTKVEIK

SEQ ID NO: 38 - protein, 110 aa, artificial sequence
  synthetic humanized sequence-MS1032LO04 VL
DIVMTQSPATLSLSPGERATLSCTSSQSVYHDNWLSWFQQKPGQPPKLLIYWASTLAYGVPSRFSGSGSGTDFTLTISSLQPEDAATYYCAGGYGGGLYAFGQGTKVEIK

SEQ ID NO: 39 - DNA, 348 bp, Oryctolagus Cuniculus
cagtcgctggaggagtccgggggtcgcctggtaacgcctggaggatccctgacagtcacctgcagagtctctggaatcgacctcagtagttacgacatcagctgggtccgccaggctccagggaaggggctggagtggatcggaatcattagttatgctggtagcacatactacgcgagctgggcaaaaggccgattcaccatctccaaaacctcgaccacggtggatctgaaaatgaccagtctgacaaccgaggacacggccacctatttctgtgccagaggtgtgcctgcttatagtactggtggtgacttgtggggcccaggcaccctggtcaccgtctcctcc

SEQ ID NO: 40 - DNA, 357 bp, Artificial Sequence
  synthetic humanized sequence-MS1032LO00 VH
caggtgacactgaaagaaagcggccccgtgctggtgaagccaaccgagacactgactctgacctgcacagtgagtgggatcgacctgagcagctacgacatctcctgggtgcggcaggcacccggaaagggcctggaatgggtcggcatcattagctacgccgggagcacatactatgccagctgggctaaaggaagactgactatctccaaggacacctctaaaaaccaggtggtcctgactatgaccaatatggaccccgtggatacagcaacttactattgtgccaggggcgtccctgcttactctaccggaggggatctgtggggacagggaaccctggtgacagtctctagt

SEQ ID NO: 41 - DNA, 330 bp, Oryctolagus Cuniculus
gcgcaagtgctgacccagactgcatcatccgtgtctgcagctgtgggaggcacagtcaccatcaattgccagtccagtcagagtgtttatgataacaactggttatcctggtttcagcagaaaccagggcagcctcccaagctcctgatctattgggcatccactctggcatctggggtcccatcgcggttcaaaggcagtggatctgggacacagttcactctcaccatcagcgacctggagtgtgacgatgctgccacttactactgtgcaggcggttatggtggtggtctgtatgctttcggcggagggaccaaggtggagatcaaa

SEQ ID NO: 42 - DNA, 330 bp, artificial sequence
  synthetic humanized sequence-MS1032LO00 VL
gacattgtgatgactcagtctcctgccactctgtcactgagccctggcgagcgagcaaccctgtcttgccagagcagccagtccgtgtacgacaacaattggctgagctggttccagcagaagccagggcagccccctaaactgctgatctattgggcatcaacactggccagcggcgtcccctccagattctccggatctggcagtgggactgactttaccctgaccatcagcagcctccagcccgaggatgccgctacctactattgtgctggcgggtacggaggcgggctgtatgcatttggacagggcacaaaggtggaaatcaaa

SEQ ID NO: 43 - DNA, 357 bp, artificial sequence
  synthetic humanized sequence-MS1032LO01 VH
caggtgacactgaaagaaagcggccccgtgctggtgaagccaaccgagacactgactctgacctgcacagtgagtgggatcgacctgagccacaccgacatctcctgggtgcggcaggcacccggaaagggcctggaatgggtcggcatcattagctacgccgggagcacatactatgccagctgggctaaaggaagactgactatctccaaggacacctctaaaaaccaggtggtcctgactatgaccaatatggaccccgtggatacagcaacttactattgtgccaggggcgtccctgcttactctcacggaggggatctgtggggacagggaaccctggtgacagtctctagt

SEQ ID NO: 44 - DNA, 357 bp, artificial sequence
  synthetic humanized sequence-MS1032LO02, 03 VH
caggtgacactgaaagaaagcggccccgtgctggtgaagccaaccgagacactgactctgacctgcacagtgagtgggatcgacctgagccacaccgacatctcctgggtgcggcaggcacccggaaagggcctggaatgggtcggcatcattagctacgccgggagcacatactatatgagctgggctaaaggaagactgactatctccaaggacacctctaaaaaccaggtggtcctgactatgaccaatatggaccccgtggatacagcaacttactattgtgccaggggcgtccctgcttactctcacggaggggatctgtggggacagggaaccctggtgacagtctctagt

SEQ ID NO: 45 - DNA, 357 bp, artificial sequence
  synthetic humanized sequence-MS1032LO04 VH
caggtgacactgaaagaaagcggccccgtgctggtgaagccaaccgagacactgactctgacctgcacagtgagtgggatcgacctgagccactacgacatctcctgggtgcggcaggcacccggaaagggcctggaatgggtcggcatcattagctacgccgggagcacatactatgccagctgggctaaaggaagactgactatctccaaggacacctctaaaaaccaggtggtcctgactatgaccaatatggaccccgtggatacagcaacttactattgtgccaggggcgtccctgcttactctcacggaggggatctgtggggacagggaaccctggtgacagtctctagt

SEQ ID NO: 46 - DNA, 330 bp, artificial sequence
  synthetic humanized sequence-MS1032LO01 VL
gacattgtgatgactcagtctcctgccactctgtcactgagccctggcgagcgagcaaccctgtcttgcaccagcagccagtccgtgtaccacaacaattggctgagctggttccagcagaagccagggcagccccctaaactgctgatctattgggcatcaacactggcctacggcgtcccctccagattctccggatctggcagtgggactgactttaccctgaccatcagcagcctccagcccgaggatgccgctacctactattgtgctggcgggtacggaggcgggcggtatgcatttggacagggcacaaaggtggaaatcaaa

SEQ ID NO: 47 - DNA, 330 bp, artificial sequence
  synthetic humanized sequence-MS1032LO02 VL
gacattgtgatgactcagtctcctgccactctgtcactgagccctggcgagcgagcaaccctgtcttgccagagcagccagtccgtgtaccacaacaattggctgagctggttccagcagaagccagggcagccccctaaactgctgatctattgggcatcaacactggccttcggcgtcccctccagattctccggatctggcagtgggactgactttaccctgaccatcagcagcctccagcccgaggatgccgctacctactattgtgctggcgggtacggaggcgggctgtatgcatttggacagggcacaaaggtggaaatcaaa

SEQ ID NO: 48 - DNA, 330 bp, artificial sequence
  synthetic humanized sequence-MS1032LO03 VL
gacattgtgatgactcagtctcctgccactctgtcactgagccctggcgagcgagcaaccctgtcttgccagaccagccagtccgtgtaccacgacaattggctgagctggttccagcagaagccagggcagccccctaaactgctgatctattgggcatcaacactggccagcggcgtcccctccagattctccggatctggcagtgggactgactttaccctgaccatcagcagcctccagcccgaggatgccgctacctactattgtgctggcgggtacggaggcgggcggtatgcatttggacagggcacaaaggtggaaatcaaa

SEQ ID NO: 49 - DNA, 330 bp, artificial sequence
  synthetic humanized sequence-MS1032LO04 VL
gacattgtgatgactcagtctcctgccactctgtcactgagccctggcgagcgagcaaccctgtcttgcaccagcagccagtccgtgtaccacgacaattggctgagctggttccagcagaagccagggcagccccctaaactgctgatctattgggcatcaacactggcctacggcgtcccctccagattctccggatctggcagtgggactgactttaccctgaccatcagcagcctccagcccgaggatgccgctacctactattgtgctggcgggtacggaggcgggctgtatgcatttggacagggcacaaaggtggaaatcaaa

SEQ ID NO: 50 - DNA, 987 bp, Homo sapiens
gcttccaccaagggcccatcggtcttccccctggcaccctcctccaagtccacctctgggggcacagcggccctgggctgcctggtcaaggactacttccccgaaccggtgacggtgtcgtggaactcaggcgccctgacctccggcgtgcacaccttcccggctgtcctacagtcctcaggactctactccctctcctccgtggtgaccgtgccctcctcgtccttgggcacccagacctacatctgcaacgtgaatcacaagccctccaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgtcccacgaagaccctgaggtcaagttcaactggtacgtggacggcgtggaggtgcataatgccaagacaaagccgcgggaggagcagtacaactccacgtaccgtgtggtctccgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggaaatgaccaagaaccaggtctccctgacctgcctggtcaaaggcttctatccctccgacatcgccgtggagtgggagtccaatgggcagccggagaacaactacaagaccacgcctcccgtgctggactccgacggctccttcttcctctactccaagctcaccgtggacaagtccaggtggcagcaggggaacgtcttctcatgctccgtgatgcatgaggctctgcacaaccactacacgcagaagtcgctctccctgtctccgtag

SEQ ID NO: 51 - DNA, 984 bp, Homo sapiens
gctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactccgggggggaccgaaagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccg

SEQ ID NO: 52 - DNA, 987 bp, Homo sapiens
gcttccaccaagggcccatcggtcttccccctggcaccctcctccaagtcgacctctgggggcacagcggccctgggctgcctggtcaaggactacttccccgaaccggtgacggtgtcgtggaactcaggcgccctgaccagtggcgtgcacaccttcccggctgtcctacagtcctcaggactctactccctcagtagtgtggtgaccgtgccctccagtagtttgggcacccagacctacatctgcaacgtgaatcacaagcccagtaacaccaaggtggacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagtcacgaagaccctgaggtcaagttcaactggtacgtggacggcgtggaggtgcataatgccaagacaaagccgcgggaggagcagtacaacagtacgtaccgtgtggtcagtgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagtctgacctgcctggtcaaaggcttctatcccagtgacatcgccgtggagtgggagagtaatgggcagccggagaacaactacaagaccacgcctcccgtgctggactccgacggctccttcttcctctacagtaagctcaccgtggacaagagtaggtggcagcaggggaacgtcttctcatgctccgtgatgcatgaggctctgcacaaccactacacgcagaagagtctctccctgtctccgtga

SEQ ID NO: 53 - DNA, 324 bp, Homo sapiens
cgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggactccaaggactgcacctactccctctcctccaccctgacgctgtccaaagcagactacgagaaacacaaagtctacgcctgcgaagtcacccatcagggcctgtcctcgcccgtcacaaagtccttcaacaggggagagtgttga

SEQ ID NO: 54 - DNA, 324 bp, Homo sapiens
cgtacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagtaaggacagtacctacagtctcagtagtaccctgacgctgtccaaagcagactacgagaaacacaaagtctacgcctgcgaagtcacccatcagggcctgtcctcgcccgtcacaaagtccttcaacaggggagagtgttga

SEQ ID NO: 55 - protein, 5 aa, Oryctolagus Cuniculus
SYDIS

SEQ ID NO: 56 - protein, 5 aa, artificial sequence
  synthetic humanized sequence-MS103205H001 etc.  HVR-H1
HYDIS

SEQ ID NO: 57 - protein, 5 aa, artificial sequence
  synthetic humanized sequence-MS1032LO01 etc.  HVR-H1
HTDIS

SEQ ID NO: 58 - protein, 16 aa, Oryctolagus Cuniculus
IISYAGSTYYASWAKG

SEQ ID NO: 59 - protein, 16 aa, artificial sequence
  synthetic humanized sequence-MS103205H009 etc.  HVR-H2
IISHAGSTYYASWAKG

SEQ ID NO: 60 - protein, 16 aa, artificial sequence
  synthetic humanized sequence-MS1032LO02, 03 HVR-H2
IISYAGSTYYMSWAKG

SEQ ID NO: 61 - protein, 11 aa, Oryctolagus Cuniculus
GVPAYSTGGDL

SEQ ID NO: 62 - protein, 11 aa, artificial sequence
  synthetic humanized sequence-MS103205H026 etc.  HVR-H3
GVPAHSTGGDL

SEQ ID NO: 63 - protein, 11 aa, artificial sequence
  synthetic humanized sequence-MS103205H028 etc.  HVR-H3
GVPAYSHGGDL

SEQ ID NO: 64 - protein, 11 aa, artificial sequence
  synthetic humanized sequence-MS103205H709 etc.  HVR-H3
GVPAHSHGGDL

SEQ ID NO: 65 - protein, 13 aa, Oryctolagus Cuniculus
QSSQSVYDNNWLS

SEQ ID NO: 66 - protein, 13 aa, artificial sequence
  synthetic humanized sequence-M103202L008 etc.  HVR-L1
QSSQSVYHNNWLS

SEQ ID NO: 67 - protein, 13 aa, artificial sequence
  synthetic humanized sequence-MS1032LO01 HVR-L1
TSSQSVYHNNWLS

SEQ ID NO: 68 - protein, 13 aa, artificial sequence
  synthetic humanized sequence-MS1032LO03 HVR-L1
QTSQSVYHDNWLS

SEQ ID NO: 69 - protein, 13 aa, artificial sequence
  synthetic humanized sequence-MS1032LO04 HVR-L1
TSSQSVYHDNWLS

SEQ ID NO: 70 - protein, 7 aa, artificial sequence
  synthetic humanized sequence-MST1032 etc.  HVR-L2
WASTLAS

SEQ ID NO: 71 - protein, 7 aa, artificial sequence
  synthetic humanized sequence-MS1032LO01 etc.  HVR-L2
WASTLAY

SEQ ID NO: 72 - protein, 7 aa, artificial sequence
  synthetic humanized sequence-MS1032LO02 HVR-L2
WASTLAF

SEQ ID NO: 73 - protein, 10 aa, Oryctolagus Cuniculus
AGGYGGGLYA

SEQ ID NO: 74 - protein, 10 aa, artificial sequence
  synthetic humanized sequence-MS1032LO01 etc.  HVR-L3
AGGYGGGRYA

SEQ ID NO: 75 - protein, 242 aa, Homo sapiens
ENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 76 - protein, 242 aa, Homo sapiens
ENSEQKENVEKEGLCNACTWRQNTKSSRIEAIKIQILSKLRLETAPNISKDAIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 77 - protein, 242 aa, Homo sapiens
EGSEREENVEKEGLCNACAWRQNTRYSRIEAIKIQILSKLRLETAPNISKDAIRQLLPRAPPLRELIDQYDVQRDDSSDGSLEDDDYHATTETIITMPTESDFLMQADGKPKCCFFKFSSKIQYNKVVKAQLWIYLRPVKTPTTVFVQILRLIKPMKDGTRYTGIRSLKLDMSPGTGIWQSIDVKTVLQNWLKQPESNLGIEIKALDENGHDLAVTFPGPGEDGLNPFLEVKVTDTPKRSRR

SEQ ID NO: 78 - protein, 266 aa, Homo sapiens
MQKLQLCVYIYLFMLIVAGPVDLNENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 79 - protein, 266 aa, artificial sequence
  cynomolgous monkey myostatin (propeptide)
MQKLQLCVYIYLFMLIVAGPVDLNENSEQKENVEKEGLCNACTWRQNTKSSRIEAIKIQILSKLRLETAPNISKDAIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 80 - protein, 267 aa, mus musculus
MMQKLQMYVYIYLFMLIAAGPVDLNEGSEREENVEKEGLCNACAWRQNTRYSRIEAIKIQILSKLRLETAPNISKDAIRQLLPRAPPLRELIDQYDVQRDDSSDGSLEDDDYHATTETIITMPTESDFLMQADGKPKCCFFKFSSKIQYNKVVKAQLWIYLRPVKTPTTVFVQILRLIKPMKDGTRYTGIRSLKLDMSPGTGIWQSIDVKTVLQNWLKQPESNLGIEIKALDENGHDLAVTFPGPGEDGLNPFLEVKVTDTPKRSRR

SEQ ID NO: 81 - protein, 407 aa, Homo sapiens
MVLAAPLLLGFLLLALELRPRGEAAEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 82 - protein, 109 aa, Homo sapiens
NLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 83 - protein, 274 aa, Homo sapiens
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 84 - protein, 298 aa, Homo sapiens
MVLAAPLLLGFLLLALELRPRGEAAEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 85 - protein, 409 aa, Homo sapiens
MKWVTFLLLLFISGSAFSDYKDDDDKAEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 86 - protein, 119 aa, artificial sequence
  synthetic humanized sequence-MS1032LO06, 24 VH
QVTLKESGPVLVKPTETLTLTCTVSGIDLSHDDISWVRQAPGKGLEWVGIISYAGSTYYASWAKGRLTISKDTSKNQVVLTMTNMDPVDTATYYCARGVPAYSHGGDLWGQGTLVTVSS

SEQ ID NO: 87 - protein, 119 aa, artificial sequence
  synthetic humanized sequence-MS1032LO07 VH
QVTLKESGPVLVKPTETLTLTCTVSGIDLSHDDISWVRQAPGKGLEWVGIISYAGSMYYASWAKGRLTISKDTSKNQVVLTMTNMDPVDTATYYCARGVPAYSHGGDKWGQGTLVTVSS

SEQ ID NO: 88 - protein, 119 aa, artificial sequence
  synthetic humanized sequence-MS1032LO10 VH
QVTLKESGPVLVKPTETLTLTCTVSGIDLSHTDISWVRQAPGKGLEWVGIISYAGKTYYASWAKKRLTISKDTSKNQVVLTMTNMDPVDTATYYCARGVPAYSHGGDLWGQGTLVTVSS

SEQ ID NO: 89 - protein, 119 aa, artificial sequence
  synthetic humanized sequence-MS1032LO11 VH
QVTLKESGPVLVKPTETLTLTCTVSGIDLSHTDISWVRQAPGKGLEWVGIISYAGKKYYASWAKGRLTISKDTSKNQVVLTMTNMDPVDTATYYCARGVPAYSHGGDLWGQGTLVTVSS

SEQ ID NO: 90 - protein, 119 aa, artificial sequence
  synthetic humanized sequence-MS1032LO12 VH
QVTLKESGPVLVKPTETLTLTCTVSGIDLSHTDISWVRQAPGKGLEWVGIISYAGSKYKASWAKGRLTISKDTSKNQVVLTMTNMDPVDTATYYCARGVPAYSHGGDLWGQGTLVTVSS

SEQ ID NO: 91 - protein, 119 aa, artificial sequence
  synthetic humanized sequence-MS1032LO18 VH
QVTLKESGPVLVKPTETLTLTCTVSGIDLSHDDISWVRQAPGKGLEWVGIISYAGKKYYASWAKGRLTISKDTSKNQVVLTMTNMDPVDTATYYCARGVPAYSHGGDLWGQGTLVTVSS

SEQ ID NO: 92 - protein, 119 aa, artificial sequence
  synthetic humanized sequence-MS1032LO19, 26 VH
QVQLVESGGGLVQPGGSLRLSCAVSGIDLSHDDISWVRQAPGKGLEWVSIISYAGSTYYASWAKGRLTISKDTSKNQVVLTMTNMDPVDTATYYCARGVPAYSHGGDLWGQGTLVTVSS

SEQ ID NO: 93 - protein, 119 aa, artificial sequence
  synthetic humanized sequence-MS1032LO21 VH
QVTLKESGPVLVKPTETLTLTCKVSGIDLSHDDISWVRQAPGKGLEWVSIISYAGSTYYASWAKGRLTISKDTSKNQVVLTMTNMDPVDTATYYCARGVPAYSHGGDLWGQGTLVTVSS

SEQ ID NO: 94 - protein, 119 aa, artificial sequence
  synthetic humanized sequence-MS1032LO23 VH
QVTLKESGPVLVKPTETLTLTCKVSGIDLSHEDISWVRQAPGKGLEWVSIISYAGSTYYASWAKGRLTISKDTSKNQVVLTMTNMDPVDTATYYCARGVPAYSHGGDLWGQGTLVTVSS

SEQ ID NO: 95 - protein, 119 aa, artificial sequence
  synthetic humanized sequence-MS1032LO25 VH
QVQLVESGGGLVQPGGSLRLSCAVSGIDLSHEDISWVRQAPGKGLEWVSIISYAGSKYYASWAKGRLTISKDTSKNQVVLTMTNMDPVDTATYYCARGVPAYSHGGDLWGQGTLVTVSS

SEQ ID NO: 96 - protein, 110 aa, artificial sequence
  synthetic humanized sequence-MS1032LO06, 07, 10, 11, 12, 18,  VL
DIVMTQSPATLSLSPGERATLSCTSSQSVYHANWLSWFQQKPGQPPKLLIYWASTLAYGVPSRFSGSGSGTDFTLTISSLQPEDAATYYCAGGYGGGRYAFGQGTKVEIK

SEQ ID NO: 97 - protein, 110 aa, artificial sequence
  synthetic humanized sequence-MS1032LO19, 21, 23, 25 VL
DIVMTQSPATLSLSPGERATLSCTTSQSVYHENWLSWFQQKPGQPPKLLIYWASTLAYGVPSRFSGSGSGTDFTLTISSLQPEDAATYYCAGGYGGGRYAFGQGTKVEIK

SEQ ID NO: 98 - protein, 110 aa, artificial sequence
  synthetic humanized sequence-MS1032LO24 VL
DIVMTQSPATLSLSPGERATLSCTSSQSVFHENWLSWFQQKPGQPPKLLIYWASTLAWGVPSRFSGSGSGTDFTLTISSLQPEDAATYYCAGGYGGGRYAFGQGTKVEIK

SEQ ID NO: 99 - protein, 110 aa, artificial sequence
  synthetic humanized sequence-MS1032LO26 VL
DIVMTQSPATLSLSPGERATLSCTTSQSVYHENWLSWYQQKPGQPPKLLIYWASTLAYGVPSRFSGSGSGTDFTLTISSLQPEDVATYYCAGGYGGGRYAFGQGTKVEIK

SEQ ID NO: 100 - DNA, 357 bp, artificial sequence
  synthetic humanized sequence-MS1032LO06, 24 VH
caggtgacactgaaagaaagcggccccgtgctggtgaagccaaccgagacactgactctgacctgcacagtgagtgggatcgacctgagccacgacgacatctcctgggtgcggcaggcacccggaaagggcctggaatgggtcggcatcattagctacgccgggagcacatactatgccagctgggctaaaggaagactgactatctccaaggacacctctaaaaaccaggtggtcctgactatgaccaatatggaccccgtggatacagcaacttactattgtgccaggggcgtccctgcttactctcacggaggggatctgtggggacagggaaccctggtgacagtctctagt

SEQ ID NO: 101 - DNA, 357 bp, artificial sequence
  synthetic humanized sequence-MS1032LO07 VH
caggtgacactgaaagaaagcggccccgtgctggtgaagccaaccgagacactgactctgacctgcacagtgagtgggatcgacctgagccacgacgacatctcctgggtgcggcaggcacccggaaagggcctggaatgggtcggcatcattagctacgccgggagcatgtactatgccagctgggctaaaggaagactgactatctccaaggacacctctaaaaaccaggtggtcctgactatgaccaatatggaccccgtggatacagcaacttactattgtgccaggggcgtccctgcttactctcacggaggggataagtggggacagggaaccctggtgacagtctctagt

SEQ ID NO: 102 - DNA, 357 bp, artificial sequence
  synthetic humanized sequence-MS1032LO10 VH
caggtgacactgaaagaaagcggccccgtgctggtgaagccaaccgagacactgactctgacctgcacagtgagtgggatcgacctgagccacaccgacatctcctgggtgcggcaggcacccggaaagggcctggaatgggtcggcatcattagctacgccgggaagacatactatgccagctgggctaaaaaaagactgactatctccaaggacacctctaaaaaccaggtggtcctgactatgaccaatatggaccccgtggatacagcaacttactattgtgccaggggcgtccctgcttactctcacggaggggatctgtggggacagggaaccctggtgacagtctctagt

SEQ ID NO: 103 - DNA, 357 bp, artificial sequence
  synthetic humanized sequence-MS1032LO11 VH
caggtgacactgaaagaaagcggccccgtgctggtgaagccaaccgagacactgactctgacctgcacagtgagtgggatcgacctgagccacaccgacatctcctgggtgcggcaggcacccggaaagggcctggaatgggtcggcatcattagctacgccgggaagaaatactatgccagctgggctaaaggaagactgactatctccaaggacacctctaaaaaccaggtggtcctgactatgaccaatatggaccccgtggatacagcaacttactattgtgccaggggcgtccctgcttactctcacggaggggatctgtggggacagggaaccctggtgacagtctctagt

SEQ ID NO: 104 - DNA, 357 bp, artificial sequence
  synthetic humanized sequence-MS1032LO12 VH
caggtgacactgaaagaaagcggccccgtgctggtgaagccaaccgagacactgactctgacctgcacagtgagtgggatcgacctgagccacaccgacatctcctgggtgcggcaggcacccggaaagggcctggaatgggtcggcatcattagctacgccgggagcaaatacaaggccagctgggctaaaggaagactgactatctccaaggacacctctaaaaaccaggtggtcctgactatgaccaatatggaccccgtggatacagcaacttactattgtgccaggggcgtccctgcttactctcacggaggggatctgtggggacagggaaccctggtgacagtctctagt

SEQ ID NO: 105 - DNA, 357 bp, artificial sequence
  synthetic humanized sequence-MS1032LO18 VH
caggtgacactgaaagaaagcggccccgtgctggtgaagccaaccgagacactgactctgacctgcacagtgagtgggatcgacctgagccacgacgacatctcctgggtgcggcaggcacccggaaagggcctggaatgggtcggcatcattagctacgccgggaagaaatactatgccagctgggctaaaggaagactgactatctccaaggacacctctaaaaaccaggtggtcctgactatgaccaatatggaccccgtggatacagcaacttactattgtgccaggggcgtccctgcttactctcacggaggggatctgtggggacagggaaccctggtgacagtctctagt

SEQ ID NO: 106 - DNA, 357 bp, artificial sequence
  synthetic humanized sequence-MS1032LO19, 26 VH
caggtgcagctggtcgaatctggaggaggactggtgcagccaggagggtcactgcgactgagctgtgccgtgtccgggatcgacctgtcacacgacgatattagctgggtgagacaggcacccgggaagggactggaatgggtctctatcattagttacgccggcagcacctactatgcctcttgggctaaaggcaggctgaccatttctaaggacacaagtaaaaaccaggtggtcctgaccatgacaaatatggaccccgtggatactgcaacctactattgcgcccggggcgtccctgcttatagccacggcggcgatctgtggggacaggggacactggtgactgtcagctcc

SEQ ID NO: 107 - DNA, 357 bp, artificial sequence
  synthetic humanized sequence-MS1032LO21 VH
caggtgacactgaaagaaagcggccccgtgctggtgaagccaaccgagacactgactctgacctgcaaagtgagtgggatcgacctgagccacgacgacatctcctgggtgcggcaggcacccggaaagggcctggaatgggtctccatcattagctacgccgggagcacatactatgccagctgggctaaaggaagactgactatctccaaggacacctctaaaaaccaggtggtcctgactatgaccaatatggaccccgtggatacagcaacttactattgtgccaggggcgtccctgcttactctcacggaggggatctgtggggacagggaaccctggtgacagtctctagt

SEQ ID NO: 108 - DNA, 357 bp, artificial sequence
  synthetic humanized sequence-MS1032LO23 VH
caggtgacactgaaagaaagcggccccgtgctggtgaagccaaccgagacactgactctgacctgcaaagtgagtgggatcgacctgagccacgaggacatctcctgggtgcggcaggcacccggaaagggcctggaatgggtctccatcattagctacgccgggagcacatactatgccagctgggctaaaggaagactgactatctccaaggacacctctaaaaaccaggtggtcctgactatgaccaatatggaccccgtggatacagcaacttactattgtgccaggggcgtccctgcttactctcacggaggggatctgtggggacagggaaccctggtgacagtctctagt

SEQ ID NO: 109 - DNA, 357 bp, artificial sequence
  synthetic humanized sequence-MS1032LO25 VH
caggtgcagctggtcgaatctggaggaggactggtgcagccaggagggtcactgcgactgagctgtgccgtgtccgggatcgacctgtcacacgaggatattagctgggtgagacaggcacccgggaagggactggaatgggtctctatcattagttacgccggcagcaagtactatgcctcttgggctaaaggcaggctgaccatttctaaggacacaagtaaaaaccaggtggtcctgaccatgacaaatatggaccccgtggatactgcaacctactattgcgcccggggcgtccctgcttatagccacggcggcgatctgtggggacaggggacactggtgactgtcagctcc

SEQ ID NO: 110 - DNA, 330 bp, artificial sequence
  synthetic humanized sequence-MS1032LO06, 07, 10, 11, 12, 18,  VL
gacattgtgatgactcagtctcctgccactctgtcactgagccctggcgagcgagcaaccctgtcttgcaccagcagccagtccgtgtaccacgccaattggctgagctggttccagcagaagccagggcagccccctaaactgctgatctattgggcatcaacactggcctacggcgtcccctccagattctccggatctggcagtgggactgactttaccctgaccatcagcagcctccagcccgaggatgccgctacctactattgtgctggcgggtacggaggcgggcggtatgcatttggacagggcacaaaggtggaaatcaaa

SEQ ID NO: 111 - DNA, 330 bp, artificial sequence
  synthetic humanized sequence-MS1032LO19, 21, 23, 25 VL
gacattgtgatgactcagtctcctgccactctgtcactgagccctggcgagcgagcaaccctgtcttgcaccaccagccagtccgtgtaccacgagaattggctgagctggttccagcagaagccagggcagccccctaaactgctgatctattgggcatcaacactggcctacggcgtcccctccagattctccggatctggcagtgggactgactttaccctgaccatcagcagcctccagcccgaggatgccgctacctactattgtgctggcgggtacggaggcgggcggtatgcatttggacagggcacaaaggtggaaatcaaa

SEQ ID NO: 112 - DNA, 330 bp, artificial sequence
  synthetic humanized sequence-MS1032LO24 VL
gacattgtgatgactcagtctcctgccactctgtcactgagccctggcgagcgagcaaccctgtcttgcaccagcagccagtccgtgttccacgagaattggctgagctggttccagcagaagccagggcagccccctaaactgctgatctattgggcatcaacactggcctggggcgtcccctccagattctccggatctggcagtgggactgactttaccctgaccatcagcagcctccagcccgaggatgccgctacctactattgtgctggcgggtacggaggcgggcggtatgcatttggacagggcacaaaggtggaaatcaaa

SEQ ID NO: 113 - DNA, 330 bp, artificial sequence
  synthetic humanized sequence-MS1032LO26 VL
gacattgtgatgactcagtctcctgccactctgtcactgagccctggcgagcgagcaaccctgtcttgcaccaccagccagtccgtgtaccacgagaattggctgagctggtaccagcagaagccagggcagccccctaaactgctgatctattgggcatcaacactggcctacggcgtcccctccagattctccggatctggcagtgggactgactttaccctgaccatcagcagcctccagcccgaggatgtcgctacctactattgtgctggcgggtacggaggcgggcggtatgcatttggacagggcacaaaggtggaaatcaaa

SEQ ID NO: 114 - protein, 5 aa, artificial sequence
  synthetic humanized sequence-MS1032LO06, 07, 18, 19, 21, 24, 26 HVR-H1
HDDIS

SEQ ID NO: 115 - protein, 5 aa, artificial sequence
  synthetic humanized sequence-MS1032LO23, 25 HVR-H1
HEDIS

SEQ ID NO: 116 - protein, 16 aa, artificial sequence
  synthetic humanized sequence-MS1032LO07 HVR-H2
IISYAGSMYYASWAKG

SEQ ID NO: 117 - protein, 16 aa, artificial sequence
  synthetic humanized sequence-MS1032LO10 HVR-H2
IISYAGKTYYASWAKK

SEQ ID NO: 118 - protein, 16 aa, artificial sequence
  synthetic humanized sequence-MS1032LO11, 18 HVR-H2
IISYAGKKYYASWAKG

SEQ ID NO: 119 - protein, 16 aa, artificial sequence
  synthetic humanized sequence-MS1032LO12 HVR-H2
IISYAGSKYKASWAKG

SEQ ID NO: 120 - protein, 16 aa, artificial sequence
  synthetic humanized sequence-MS1032LO25 HVR-H2
IISYAGSKYYASWAKG

SEQ ID NO: 121 - protein, 11 aa, artificial sequence
  synthetic humanized sequence-MS1032LO07 HVR-H3
GVPAYSHGGDK

SEQ ID NO: 122 - protein, 13 aa, artificial sequence
  synthetic humanized sequence-MS1032LO06, 07, 10, 11, 12, 18 HVR-L1
TSSQSVYHANWLS

SEQ ID NO: 123 - protein, 13 aa, artificial sequence
  synthetic humanized sequence-MS1032LO19, 21, 23, 25, 26 HVR-L1
TTSQSVYHENWLS

SEQ ID NO: 124 - protein, 13 aa, artificial sequence
  synthetic humanized sequence-MS1032LO24 HVR-L1
TSSQSVFHENWLS

SEQ ID NO: 125 - protein, 7 aa, artificial sequence
  synthetic humanized sequence-MS1032LO24 HVR-L2
WASTLAW

SEQ ID NO: 126 - protein, 5 aa, artificial sequence
  synthetic humanized sequence-1032LOxx HVR-H1
  MISC_FEATURE (1)..(1): Xaa can be Ser or His
  MISC_FEATURE (2)..(2): Xaa can be Tyr, Thr, Asp, or Glu
XXDIS

SEQ ID NO: 127 - protein, 16 aa, artificial sequence
  synthetic humanized sequence-1032LOxx HVR-H2
  MISC_FEATURE (4)..(4): Xaa can be Tyr or His
  MISC_FEATURE (7)..(7): Xaa can be Ser or Lys
  MISC_FEATURE (8)..(8): Xaa can be Thr, Met, or Lys
  MISC_FEATURE (10)..(10): Xaa can be Tyr or Lys
  MISC_FEATURE (11)..(11): Xaa can be Ala, Met or Glu
  MISC_FEATURE (12)..(12): Xaa can be Ser or Glu
  MISC_FEATURE (16)..(16): Xaa can be Gly or Lys
IISXAGXXYXXXWAKX

SEQ ID NO: 128 - protein, 11 aa, artificial sequence
  synthetic humanized sequence-1032LOxx HVR-H3
  MISC_FEATURE (5)..(5): Xaa can be Tyr or His
  MISC_FEATURE (7)..(7): Xaa can be Thr or His
  MISC_FEATURE (11)..(11): Xaa can be Leu or Lys
GVPAXSXGGDX

SEQ ID NO: 129 - protein, 13 aa, artificial sequence
  synthetic humanized sequence-1032LOxx HVR-L1
  MISC_FEATURE (1)..(1): Xaa can be Gln or Thr
  MISC_FEATURE (2)..(2): Xaa can be Ser or Thr
  MISC_FEATURE (5)..(5): Xaa can be Ser or Glu
  MISC_FEATURE (7)..(7): Xaa can be Tyr or Phe
  MISC_FEATURE (8)..(8): Xaa can be Asp or His
  MISC_FEATURE (9)..(9): Xaa can be Asn, Asp, Ala, or Glu
XXSQXVXXXNWLS

SEQ ID NO: 130 - protein, 7 aa, artificial sequence
  synthetic humanized sequence-1032LOxx HVR-L2
  MISC_FEATURE (3)..(3): Xaa can be Ser or Glu
  MISC_FEATURE (7)..(7): Xaa can be Ser, Tyr, Phe, or Trp
WAXTLAX

SEQ ID NO: 131 - protein, 10 aa, artificial sequence
  synthetic humanized sequence-1032LOxx HVR-L3
  MISC_FEATURE (8)..(8): Xaa can be Leu or Arg
AGGYGGGXYA

SEQ ID NO: 132 - protein, 30 aa, Homo sapiens
QVTLKESGPVLVKPTETLTLTCTVSGIDLS

SEQ ID NO: 133 - protein, 30 aa, Homo sapiens
QVQLVESGGGLVQPGGSLRLSCAVSGIDLS

SEQ ID NO: 134 - protein, 30 aa, Homo sapiens
QVTLKESGPVLVKPTETLTLTCKVSGIDLS

SEQ ID NO: 135 - protein, 14 aa, Homo sapiens
WVRQAPGKGLEWVG

SEQ ID NO: 136 - protein, 14 aa, Homo sapiens
WVRQAPGKGLEWVS

SEQ ID NO: 137 - protein, 32 aa, Homo sapiens
RLTISKDTSKNQVVLTMTNMDPVDTATYYCAR

SEQ ID NO: 138 - protein, 11 aa, Homo sapiens
WGQGTLVTVSS

SEQ ID NO: 139 - protein, 23 aa, Homo sapiens
DIVMTQSPATLSLSPGERATLSC

SEQ ID NO: 140 - protein, 15 aa, Homo sapiens
WFQQKPGQPPKLLIY

SEQ ID NO: 141 - protein, 15 aa, Homo sapiens
WYQQKPGQPPKLLIY

SEQ ID NO: 142 - protein, 32 aa, Homo sapiens
GVPSRFSGSGSGTDFTLTISSLQPEDAATYYC

SEQ ID NO: 143 - protein, 32 aa, Homo sapiens
GVPSRFSGSGSGTDFTLTISSLQPEDVATYYC

SEQ ID NO: 144 - protein, 10 aa, Homo sapiens
FGQGTKVEIK

SEQ ID NO: 145 - protein, 121 aa, Oryctolagus Cuniculus
QSVEESGGRLVTPGTPLTLTCTVSGFSLSRYYVSWVRQAPGKGLEWIGIIYTGGNTNYASWAKGRFTISKASTTVDLKMTGPTTEDTATYFCAGFLDYSHYTTGGYYLDLWGPGTLVTVSS

SEQ ID NO: 146 - protein, 119 aa, Oryctolagus Cuniculus
QSLEESGGGLVKPGGTLTLTCKASGIDFSSYYYMCWVRQAPGKGLEWIACIYAGISGSTYYASWAKGRFTISKTSSTTVTLQMTSLTAADTATYFCARDPYHFDYGSLWGPGTLVTVSS

SEQ ID NO: 147 - protein, 116 aa, Oryctolagus Cuniculus
QSLEESGGRLVTPGTPLTLTCTVSGIDLSRYWMSWVRQAPGKGLEWIGIISSGGTTYYASWAKGRFTISKTSTTVDLKITSPTTEDTATYFCARDSRYGAARLDLWGQGTLVTVSS

SEQ ID NO: 148 - protein, 109 aa, Oryctolagus Cuniculus
QSVEESGGRLVTPGTPLTLTCTVSGFSLSSYIMGWVRQAPGKGLEWIGFIYVSGSTYYASWAKGRFTISRTSTTVDLRITSPTTEDTATYFCVRTWDLWGPGTLVTVSS

SEQ ID NO: 149 - protein, 115 aa, Oryctolagus Cuniculus
QSVEESGGRLVTPGTPLTLTCTVSGFSLSSYAMSWVRQAPGKGLEWIGIIYGVGSTYYASWAKGRFTISKTSTTVDLKIASPTTEDTATYFCARDDYGWGYTNLWGPGTLVTVSS

SEQ ID NO: 150 - protein, 117 aa, Oryctolagus Cuniculus
QSVEESGGRLVTPGTPLTLTCTVSGIDLSSSSMIWVRQAPGEGLKYIGFISKSGYTYYASWAKGRFTISKTSTTVDLKITSPTTEDTATYFCARGGYSGDWDYFTLWGPGTLVTVSS

SEQ ID NO: 151 - protein, 112 aa, Oryctolagus Cuniculus
QVLTQTPSPVSAAVGGTVTINCQASQSVYNNKNLAWYQQKPGQPPKLLIYYASTLPSGVSSRFKGSGSGTQFTLTISGVQCDDAATYYCQGEFSCGSADCTAFGGGTKVEIK

SEQ ID NO: 152 - protein, 112 aa, Oryctolagus Cuniculus
ALVMTQTPASVSAAVGGTVTINCQASQSVYGGNELSWYQQEPGQPPKLLIYSASKLASGVPSRFKGSGSGTQFTLTISGVQCDDAAAYYCAGYRTYSDDDNAFGGGTKVEIK

SEQ ID NO: 153 - protein, 112 aa, Oryctolagus Cuniculus
QVLTQTPASVSAAVGGTVTINCQSSQSVAGNDNLAWYQQKPGQPPKLLIYYASNLASGVSSRFKGSGSGTRFTLTISDVQCDDAATYYCLGNYDCSSADCDAFGGGTKVEIK

SEQ ID NO: 154 - protein, 109 aa, Oryctolagus Cuniculus
QVLTQTPSSTSAAVGGTVTINCQSSQSVYDNNWLAWYQQKPGQPPKRLIYGASTLDSGVPSRFKGSGSGTEFTLTISDLECDDAATYYCQGGYSGNIYPFGGGTKVEIK

SEQ ID NO: 155 - protein, 111 aa, Oryctolagus Cuniculus
QVLTQTPSSVSAAVGGTVTINCQSSQSVYNNNYLAWFQQKPGQPPKLLIYDASKLASGVPSRFKGSGSGTQFTLTISGVQCDDAATYYCQGSYYSSGWYRAFGGGTKVEIK

SEQ ID NO: 156 - protein, 114 aa, Oryctolagus Cuniculus
ADIVMTQTPASVEAAVGGTVTIKCQASESIGNALAWYQQKPGQPPKLLIYGAFNLESGVPSRFRGSGSGTEYTLTISDLECDDAATYYCQGYFWSSSTIYAFWAFGGGTKVEIK

SEQ ID NO: 157 - protein, 5 aa, Oryctolagus Cuniculus
RYYVS

SEQ ID NO: 158 - protein, 6 aa, Oryctolagus Cuniculus
SYYYMC

SEQ ID NO: 159 - protein, 5 aa, Oryctolagus Cuniculus
RYWMS

SEQ ID NO: 160 - protein, 5 aa, Oryctolagus Cuniculus
SYIMG

SEQ ID NO: 161 - protein, 5 aa, Oryctolagus Cuniculus
SYAMS

SEQ ID NO: 162 - protein, 5 aa, Oryctolagus Cuniculus
SSSMI

SEQ ID NO: 163 - protein, 16 aa, Oryctolagus Cuniculus
IIYTGGNTNYASWAKG

SEQ ID NO: 164 - protein, 18 aa, Oryctolagus Cuniculus
CIYAGISGSTYYASWAKG

SEQ ID NO: 165 - protein, 16 aa, Oryctolagus Cuniculus
IISSGGTTYYASWAKG

SEQ ID NO: 166 - protein, 16 aa, Oryctolagus Cuniculus
FIYVSGSTYYASWAKG

SEQ ID NO: 167 - protein, 16 aa, Oryctolagus Cuniculus
IIYGVGSTYYASWAKG

SEQ ID NO: 168 - protein, 16 aa, Oryctolagus Cuniculus
FISKSGYTYYASWAKG

SEQ ID NO: 169 - protein, 16 aa, Oryctolagus Cuniculus
FLDYSHYTTGGYYLDL

SEQ ID NO: 170 - protein, 10 aa, Oryctolagus Cuniculus
DPYHFDYGSL

SEQ ID NO: 171 - protein, 11 aa, Oryctolagus Cuniculus
DSRYGAARLDL

SEQ ID NO: 172 - protein, 4 aa, Oryctolagus Cuniculus
TWDL

SEQ ID NO: 173 - protein, 10 aa, Oryctolagus Cuniculus
DDYGWGYTNL

SEQ ID NO: 174 - protein, 12 aa, Oryctolagus Cuniculus
GGYSGDWDYFTL

SEQ ID NO: 175 - protein, 13 aa, Oryctolagus Cuniculus
QASQSVYNNKNLA

SEQ ID NO: 176 - protein, 13 aa, Oryctolagus Cuniculus
QASQSVYGGNELS

SEQ ID NO: 177 - protein, 13 aa, Oryctolagus Cuniculus
QSSQSVAGNDNLA

SEQ ID NO: 178 - protein, 13 aa, Oryctolagus Cuniculus
QSSQSVYDNNWLA

SEQ ID NO: 179 - protein, 13 aa, Oryctolagus Cuniculus
QSSQSVYNNNYLA

SEQ ID NO: 180 - protein, 11 aa, Oryctolagus Cuniculus
QASESIGNALA

SEQ ID NO: 181 - protein, 7 aa, Oryctolagus Cuniculus
YASTLPS

SEQ ID NO: 182 - protein, 7 aa, Oryctolagus Cuniculus
SASKLAS

SEQ ID NO: 183 - protein, 7 aa, Oryctolagus Cuniculus
YASNLAS

SEQ ID NO: 184 - protein, 7 aa, Oryctolagus Cuniculus
GASTLDS

SEQ ID NO: 185 - protein, 7 aa, Oryctolagus Cuniculus
DASKLAS

SEQ ID NO: 186 - protein, 7 aa, Oryctolagus Cuniculus
GAFNLES

SEQ ID NO: 187 - protein, 13 aa, Oryctolagus Cuniculus
QGEFSCGSADCTA

SEQ ID NO: 188 - protein, 12 aa, Oryctolagus Cuniculus
AGYRTYSDDDNA

SEQ ID NO: 189 - protein, 13 aa, Oryctolagus Cuniculus
LGNYDCSSADCDA

SEQ ID NO: 190 - protein, 10 aa, Oryctolagus Cuniculus
QGGYSGNIYP

SEQ ID NO: 191 - protein, 12 aa, Oryctolagus Cuniculus
QGSYYSSGWYRA

SEQ ID NO: 192 - protein, 15 aa, Oryctolagus Cuniculus
QGYFWSSSTIYAFWA

SEQ ID NO: 193 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRRGPKVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 194 - DNA, 324 bp, Homo sapiens
cgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagtaaggactgcacctacagtctcagtagtaccctgacgctgtccaaagcagactacgagaaacacaaagtctacgcctgcgaagtcacccatcagggcctgtcctcgcccgtcacaaagtccttcaacaggggagagtgttga

SEQ ID NO: 195 - protein, 330 aa, Homo sapiens [sequence omitted]

SEQ ID NO: 196 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 197 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 198 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 199 - DNA, 1125 bp, Homo sapiens
atgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtag

SEQ ID NO: 200 - DNA, 951 bp, Homo sapiens
atgactatggagacccaaatgtctcagaatgtatgtcccagaaacctgtggctgcttcaaccattgacagttttgctgctgctggcttctgcagacagtcaagctgctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatgggggtcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaa

SEQ ID NO: 201 - DNA, 954 bp, Homo sapiens
atgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaa

SEQ ID NO: 202 - DNA, 876 bp, Homo sapiens
atgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttag

SEQ ID NO: 203 - DNA, 933 bp, Homo sapiens
atgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttag

SEQ ID NO: 204 - DNA, 765 bp, Homo sapiens
atgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagttgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttgtcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatga

SEQ ID NO: 205 - DNA, 765 bp, Homo sapiens
atgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatga

SEQ ID NO: 206 - DNA, 702 bp, Homo sapiens
atgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttga

SEQ ID NO: 207 - protein, 374 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 208 - protein, 316 aa, Homo sapiens
MTMETQMSQNVCPRNLWLLQPLTVLLLLASADSQAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGVIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 209 - protein, 317 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 210 - protein, 218 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSRLDPTFSIPQANHSHSGDYHCTGNIGYTLFSSKPVTITVQVPSMGSSSPMGI

SEQ ID NO: 211 - protein, 218 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGI

SEQ ID NO: 212 - protein, 291 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 213 - protein, 310 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 214 - protein, 217 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAP

SEQ ID NO: 215 - protein, 254 aa, Homo sapiens [sequence omitted]

SEQ ID NO: 216 - protein, 254 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 217 - protein, 208 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQ

SEQ ID NO: 218 - protein, 208 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQ

SEQ ID NO: 219 - protein, 233 aa, Homo sapiens
MWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 220 - protein, 211 aa, artificial sequence
  cynomolgous monkey- cynoFcgRIIa1
MSQNVCPGNLWLLQPLTVLLLLASADSQTAPPKAVLKLEPPWINVLREDSVTLTCGGAHSPDSDSTQWFHNGNLIPTHTQPSYRFKANNNDSGEYRCQTGRTSLSDPVHLTVLSEWLALQTPHLEFREGETIMLRCHSWKDKPLIKVTFFQNGIAKKFSHMDPNFSIPRANHSHSGDYHCTGNIGYTPYSSKPVTITVQVPSVGSSSPMGI

SEQ ID NO: 221 - protein, 211 aa, artificial sequence
  cynomolgous monkey-cynoFcgRIIa2
MSQNVCPGNLWLLQPLTVLLLLASADSQTAPPKAVLKLEPPWINVLREDSVTLTCGGAHSPDSDSTQWFHNGNLIPTHTQPSYRFKANNNDSGEYRCQTGRTSLSDPVHLTVLSEWLALQTTHLEFREGETIMLRCHSWKDKPLIKVAFFQNGKSKNFSHMNPNFSIPQANHSHSGDYHCTGNIGYTPYSSKPVTITVQVPSVGSSSPMGI

SEQ ID NO: 222 - protein, 211 aa, artificial sequence
  cynomolgous monkey- cynoFcgRIIa3
MSQNVCPGNLWLLQPLTVLLLLASADSQTAPPKAVLKLEPPWINVLREDSVTLTCGGAHSPDSDSTQWFHNGNLIPTHTQPSYRFKANNNDSGEYRCQTGRTSLSDPVHLTVLSEWLALQTTHLEFREGETIMLRCHSWKDKPLIKVAFFQNGISKKFSPMNPNFSIPRANHSHSGDYHCTGNIGYTPYSSKPVTITVQVPSVGSSSPMGI

SEQ ID NO: 223 - protein, 217 aa, artificial sequence
  cynomolgous monkey-cynoFcgRIIb
MGILSFLPVLATESDWADCKSSQPWGHMLLWTAVLFLAPVAGTPAAPPKAVLKLEPPWINVLREDSVTLTCGGAHSPDSDSTQWFHNGNLIPTHTQPSYRFKANNNDSGEYRCQTGRTSLSDPVHLTVLSEWLALQTPHLEFREGETIMLRCHSWKDKPLIKVTFFQNGISKKFSHMNPNFSIPQANHSHSGDYHCTGNIGYTPYSSKPVTITVQVP

SEQ ID NO: 224 - protein, 208 aa, artificial sequence
  cynomolgous monkey-cynoFcgRIIIaS
MWQLLLPTALLLLVSAGMRAEDLPKAVVFLEPQWYRVLEKDSVTLKCQGAYSPEDNSTRWFHNESLISSQTSSYFIAAARVNNSGEYRCQTSLSTLSDPVQLEVHIGWLLLQAPRWVFKEEESIHLRCHSWKNTLLHKVTYLQNGKGRKYFHQNSDFYIPKATLKDSGSYFCRGLIGSKNVSSETVNITITQDLAVSSISSFFPPGYQ

SEQ ID NO: 225 - protein, 115 aa, Homo sapiens
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSS

SEQ ID NO: 226 - protein, 219 aa, Homo sapiens
DIVMTQSPLSLPVTPGEPASISCQASESLVHSNRNTYLHWYLQKPGQSPQLLIYKVSNRFSGVPDRFSGSGSGTDFTLKISRVEAEDVGVYYCSQNTHVPPTFGQGTKVEIERTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 227 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 228 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 229 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSEEDPEVKFNWYVDGVEVHNAKTKPREEQYNSTYRVVSVLTVLHQDWLNGKEYKCKVSNKALPKPIEKTISKAKGQPREPQVYTLPPSREEMTKNQVSLTCLVKGFYPSDIAVEWESNGQPENNYKTTPMVLDSDGSFFLYSKLTVDKSRWQQGNVFSCSVMHEALHNHYTQKSLSLSP

SEQ ID NO: 230 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSEEDPEVKFNWYVDGVEVHNAKTKPREEQYNSTYRVVSVLTVLHQDWLNGKEYKCKVSNKALPKPIEKTISKAKGQPREPQVYTLPPSREEMTKNQVSLTCLVKGFYPSDIAVEWESNGQPENNYKTTPMVLDRDGSFFLYSKLTVKKSRWQQGNVFSCSVMHEALHNHYTQKSLSLSP

SEQ ID NO: 231 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREEQYNSTYRVVSVLTVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 232 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREEQYNSTYRVVSVLTVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 233 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREELYNSTYRVVSVLTVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 234 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREELYNSTYRVVSVLTVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 235 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLTGPSVFLFPPKPKDTLMISRTPEVTCVVVDVSDEDPEVKFNWYVDGVEVHNAKTKPREEQYNSTYRVVSVLTVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 236 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSEEDPEVKFNWYVDGVEVHNAKTKPREEQYNSTYRVVSVLTVLHQDWLNGKEYKCKVSNKALPKPIEKTISKAKGQPREPQVYTLPPSREEMTKNQVSLTCLVKGFYPSDIAVEWESNGQPENNYKTTPMVLDSDGSFFLYSKLTVDKSRWQQGNVFSCSVMHEALHAHYTQKSLSLSP

SEQ ID NO: 237 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSEEDPEVKFNWYVDGVEVHNAKTKPREEQYNSTYRVVSVLTVLHRDWLNGKEYKCKVSNKALPKPIEKTISKAKGQPREPQVYTLPPSREEMTKNQVSLTCLVKGFYPSDIAVEWESNGQPENNYKTTPMVLRSDGSFFLYSKLTVDKSRWQQGNVFSCSVMHEALHAHYTQKSLSLSP

SEQ ID NO: 238 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREELYNSTYRVVSVLTVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTQKSLSLSP

SEQ ID NO: 239 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREEQYNSTYRVVSVLTVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTQKSLSLSP

SEQ ID NO: 240 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREEQYNSTYRVVSVLTVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTQKSLSLSP

SEQ ID NO: 241 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLTGPSVFLFPPKPKDTLMISRTPEVTCVVVDVSDEDPEVKFNWYVDGVEVHNAKTKPREEQYNSTYRVVSVLTVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTQKSLSLSP

SEQ ID NO: 242 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREELYNSTYRVVSVLTVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHTTRKELSLSP

SEQ ID NO: 243 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREELYNSTYRVVSVLTVLHRDWLNGKEYKCKVSNTALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 244 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELWNGPSVFLFPPKPKDTLMISRTPEVTCVVVDVSDEDPEVKFNWYVDGVEVHNAKTKPREELYNSTYRVVSVLTVLHRDWLNGKEYKCKVSNTALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 245 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREELYNSTYRVVSVLTVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTRKELSLSP

SEQ ID NO: 246 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREELYNSTYRVVSVLTVLHRDWLNGKEYKCKVSNTALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 247 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELWNGPSVFLFPPKPKDTLMISRTPEVTCVVVDVSDEDPEVKFNWYVDGVEVHNAKTKPREELYNSTYRVVSVLTVLHRDWLNGKEYKCKVSNTALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 248 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREEQYNSTYRVVSVLTVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVRKSRWQQGNVFSCSVMHEALHNHYTQKSLSLSP

SEQ ID NO: 249 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREEQYNSTYRVVSVLTVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 250 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREEQYNSTYRVVSVLTVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVRKSRWQQGNVFSCSVMHEALHNHYTQKSLSLSP

SEQ ID NO: 251 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLNGPSVFLFPPKPKDTLMISRTPEVTCVVVDVSDEDPEVKFNWYVDGVEVHNAKTKPREEQYNSTYRVVSVLTVLHRDWLNGKEYKCKVSNKALPKPIEKTISKAKGQPREPQVYTLPPSREEMTKNQVSLTCLVKGFYPSDIAVEWESRGQPENNYKTTPPVLDSDGSFFLYSKLTVRKSRWQQGNVFSCSVMHEALHNHYTQKSLSLSP

SEQ ID NO: 252 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 253 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 254 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 255 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 256 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 257 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 258 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 259 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 260 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 261 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 262 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 263 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 264 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 265 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 266 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 267 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 268 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 269 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 270 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 271 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 272 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 273 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 274 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 275 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 276 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 277 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHNHYTQKSLSLSP

SEQ ID NO: 278 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 279 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 280 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 281 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 282 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 283 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 284 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 285 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 286 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 287 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 288 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 289 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTRKELSLSP

SEQ ID NO: 290 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 291 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTRKELSLSP

SEQ ID NO: 292 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 293 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTRKELSLSP

SEQ ID NO: 294 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 295 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTRKELSLSP

SEQ ID NO: 296 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 297 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTRKELSLSP

SEQ ID NO: 298 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 299 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTRKELSLSP

SEQ ID NO: 300 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 301 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTRKELSLSP

SEQ ID NO: 302 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHYTRKELSLSP

SEQ ID NO: 303 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHYTRKELSLSP

SEQ ID NO: 304 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 305 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 306 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 307 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 308 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 309 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 310 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 311 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 312 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 313 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 314 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 315 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHTTRKELSLSP

SEQ ID NO: 316 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 317 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHTTRKELSLSP

SEQ ID NO: 318 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 319 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHTTRKELSLSP

SEQ ID NO: 320 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 321 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHTTRKELSLSP

SEQ ID NO: 322 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 323 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHTTRKELSLSP

SEQ ID NO: 324 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 325 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHTTRKELSLSP

SEQ ID NO: 326 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 327 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHTTRKELSLSP

SEQ ID NO: 328 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVMHEALHAHTTRKELSLSP

SEQ ID NO: 329 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVMHEALHAHTTRKELSLSP

SEQ ID NO: 330 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 331 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 332 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 333 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 334 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 335 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 336 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 337 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 338 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 339 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 340 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 341 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHTTRKELSLSP

SEQ ID NO: 342 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 343 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHTTRKELSLSP

SEQ ID NO: 344 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 345 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHTTRKELSLSP

SEQ ID NO: 346 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 347 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHTTRKELSLSP

SEQ ID NO: 348 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 349 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHTTRKELSLSP

SEQ ID NO: 350 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 351 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHTTRKELSLSP

SEQ ID NO: 352 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 353 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHTTRKELSLSP

SEQ ID NO: 354 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHTTRKELSLSP

SEQ ID NO: 355 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHTTRKELSLSP

SEQ ID NO: 356 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 357 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 358 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 359 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 360 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 361 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 362 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 363 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 364 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 365 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHQDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 366 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 367 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHYTRKELSLSP

SEQ ID NO: 368 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 369 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHYTRKELSLSP

SEQ ID NO: 370 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 371 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHYTRKELSLSP

SEQ ID NO: 372 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 373 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHYTRKELSLSP

SEQ ID NO: 374 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 375 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVVDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHYTRKELSLSP

SEQ ID NO: 376 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 377 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHYTRKELSLSP

SEQ ID NO: 378 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 379 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVSHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHYTRKELSLSP

SEQ ID NO: 380 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQRREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSP

SEQ ID NO: 381 - protein, 328 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGDSVFLFPPKPKDVLMISRTPEVTCVVIDVAHEDPEVKFNWYVDGVEVHNAKTKPREEQYNSTYRVVSVLPVLHRDWLNGKEYKCKVSNKALPKPIEKTISKAKGQPREPQVYTLPPSREEMTKNQVSLTCLVKGFYPSDIAVEWESNGQPENNYKTTPPVLDSDGSFFLYSKLTVKKSRWQQGNVFSCSVLHEALHAHYTRKELSLSP

SEQ ID NO: 382 - protein, 8 aa, Homo sapiens
YAFGQGTK

SEQ ID NO: 383 - protein, 9 aa, Homo sapiens
GTDVQAWIR

What is claimed is:

1. An isolated antibody that binds to latent myostatin, wherein the antibody comprises:
   (a) a HVR-H1 comprising the amino acid sequence $X_1X_2$DIS (SEQ ID NO: 126), wherein $X_1$ is S or H, $X_2$ is Y, T, D or E;
   (b) a HVR-H2 comprising the amino acid sequence IIS$X_1$AG$X_2X_3$Y$X_4X_5X_6$W AK$X_7$ (SEQ ID NO: 127), wherein $X_1$ is Y or H, $X_2$ is S or K, $X_3$ is T, M or K, $X_4$ is Y or K, $X_5$ is A, M or E, $X_6$ is S or E, $X_7$ is G or K;
   (c) a HVR-H3 comprising the amino acid sequence GVPA$X_1$S$X_2$GGD$X_3$ (SEQ ID NO: 128), wherein $X_1$ is Y or H, $X_2$ is T or H, $X_3$ is L or K;
   (d) a HVR-L1 comprising the amino acid sequence $X_1X_2$SQ$X_3$V$X_4X_5X_6$NWLS (SEQ ID NO: 129), wherein $X_1$ is Q or T, $X_2$ is S or T, $X_3$ is S or E, $X_4$ is Y or F, $X_5$ is D or H, $X_6$ is N, D, A or E;
   (e) a HVR-L2 comprising the amino acid sequence WA$X_1$TLA$X_2$ (SEQ ID NO: 130), wherein $X_1$ is S or E, $X_2$ is S, Y, F or W (SEQ ID NO: 130); and
   (f) a HVR-L3 comprising the amino acid sequence AGGYGGG$X_1$YA (SEQ ID NO: 131), wherein $X_1$ is L or R.

2. The antibody of claim 1, wherein,
   (a) the antibody of claim 1 further comprises a heavy chain variable domain framework FR1 comprising the amino acid sequence of SEQ ID NO: 132, 133, or 134; FR2 comprising the amino acid sequence of SEQ ID NO: 135 or 136; FR3 comprising the amino acid sequence of SEQ ID NO: 137; and FR4 comprising the amino acid sequence of SEQ ID NO: 138; or
   (b) the antibody of claim 1 further comprises a light chain variable domain framework FR1 comprising the amino acid sequence of SEQ ID NO: 139; FR2 comprising the amino acid sequence of SEQ ID NO: 140 or 141; FR3 comprising the amino acid sequence of SEQ ID NO: 142 or 143; and FR4 comprising the amino acid sequence of SEQ ID NO: 144.

3. The antibody of claim 1, which is a full length IgG antibody.

4. The antibody of claim 3, wherein the IgG antibody is IgG1, IgG2, IgG3 or IgG4.

5. The antibody of claim 4 wherein the IgG antibody is IgG1.

6. The antibody of claim 1, which comprises a variant Fc region amino acid sequence of SEQ ID NO: 229-380, or 381.

7. A pharmaceutical formulation comprising the antibody of claim 1 and a pharmaceutically acceptable carrier.

8. An isolated antibody that binds to latent myostatin, comprising (a) a VH sequence of SEQ ID NO: 13, 16-30, 32-34, 86-94, or 95; and (b) a VL sequence of SEQ ID NO:15, 31, 35-38, 96-98, or 99.

9. The antibody of claim 8, further comprising a variant Fc region amino acid sequence of SEQ ID NO: 229-380, or 381.

10. The antibody of claim 8, which is a full length IgG antibody.

11. The antibody of claim 10, wherein the IgG antibody is IgG1, IgG2, IgG3 or IgG4.

12. The antibody of claim 11, wherein the IgG antibody is IgG1.

13. A pharmaceutical composition comprising the antibody of claim 8 and a pharmaceutically acceptable carrier.

14. An isolated antibody that binds to latent myostatin, wherein the antibody comprises a VH and VL pair selected from the group consisting of:
   (a) a VH of SEQ ID NO: 87 and a VL of SEQ ID NO: 96;
   (b) a VH of SEQ ID NO: 88 and a VL of SEQ ID NO: 96;
   (c) a VH of SEQ ID NO: 89 and a VL of SEQ ID NO: 96;
   (d) a VH of SEQ ID NO: 90 and a VL of SEQ ID NO: 96;
   (e) a VH of SEQ ID NO: 91 and a VL of SEQ ID NO: 96;
   (f) a VH of SEQ ID NO: 93 and a VL of SEQ ID NO: 97;
   (g) a VH of SEQ ID NO: 94 and a VL of SEQ ID NO: 97;
   (h) a VH of SEQ ID NO: 86 and a VL of SEQ ID NO: 98; and
   (i) a VH of SEQ ID NO: 95 and a VL of SEQ ID NO: 97.

15. The antibody of claim 14, which is a full length IgG antibody.

16. The antibody of claim 15, wherein the IgG antibody is IgG1, IgG2, IgG3 or IgG4.

17. The antibody of claim 16, wherein the IgG antibody is IgG1.

18. The antibody of claim 14, which comprises a variant Fc region amino acid sequence of SEQ ID NO: 229-380, or 381.

19. A pharmaceutical composition comprising the antibody of claim 14 and a pharmaceutically acceptable carrier.

20. An isolated antibody that binds to latent myostatin and comprises a VH of SEQ ID NO: 86 and a VL of SEQ ID NO: 96.

21. The antibody of claim 20, which is a full length IgG antibody.

22. The antibody of claim 21, wherein the IgG antibody is IgG1, IgG2, IgG3 or IgG4.

23. The antibody of claim 22, wherein the IgG antibody is IgG1.

24. The antibody of claim 20, which comprises a variant Fc region amino acid sequence of SEQ ID NO: 229-380, or 381.

25. A pharmaceutical composition comprising the antibody of claim 20 and a pharmaceutically acceptable carrier.

26. An isolated antibody that binds to latent myostatin and comprises a VH of SEQ ID NO: 92 and a VL of SEQ ID NO: 97.

27. The antibody of claim 26, which is a full length IgG antibody.

28. The antibody of claim 27, wherein the IgG antibody is IgG1, IgG2, IgG3 or IgG4.

29. The antibody of claim 28, wherein the IgG antibody is IgG1.

30. The antibody of claim 26, further comprising a variant Fc region amino acid sequence of SEQ ID NO: 229-380, or 381.

31. A pharmaceutical composition comprising the antibody of claim 26 and a pharmaceutically acceptable carrier.

32. An isolated antibody that binds to latent myostatin, wherein the antibody comprises:
   (a) a HVR-H1 comprising the amino acid sequence of SEQ ID NO: 114;
   (b) a HVR-H2 comprising the amino acid sequence of SEQ ID NO: 58;
   (c) a HVR-H3 comprising the amino acid sequence of SEQ ID NO: 63;
   (d) a HVR-L1 comprising the amino acid sequence of SEQ ID NO: 122 or 123;
   (e) a HVR-L2 comprising the amino acid sequence of SEQ ID NO: 71; and
   (f) a HVR-L3 comprising the amino acid sequence of SEQ ID NO: 74.

33. The antibody of claim 32, wherein the antibody comprises:
   (a) a HVR-H1 comprising the amino acid sequence of SEQ ID NO: 114;

(b) a HVR-H2 comprising the amino acid sequence of SEQ ID NO: 58;

(c) a HVR-H3 comprising the amino acid sequence of SEQ ID NO: 63;

(d) a HVR-L1 comprising the amino acid sequence of SEQ ID NO: 122;

(e) a HVR-L2 comprising the amino acid sequence of SEQ ID NO: 71; and (f) a HVR-L3 comprising the amino acid sequence of SEQ ID NO: 74.

34. The antibody of claim 32, wherein the antibody comprises:

(a) a HVR-H1 comprising the amino acid sequence of SEQ ID NO: 114;

(b) a HVR-H2 comprising the amino acid sequence of SEQ ID NO: 58;

(c) a HVR-H3 comprising the amino acid sequence of SEQ ID NO: 63;

(d) a HVR-L1 comprising the amino acid sequence of SEQ ID NO: 123;

(e) a HVR-L2 comprising the amino acid sequence of SEQ ID NO: 71; and (f) a HVR-L3 comprising the amino acid sequence of SEQ ID NO: 74.

35. The antibody of claim 32, wherein the antibody comprises the VH of SEQ ID NO: 92.

36. The antibody of claim 32, wherein the antibody comprises the VH of SEQ ID NO: 86.

37. The antibody of claim 32, wherein the antibody comprises the VL of SEQ ID NO: 96.

38. The antibody of claim 32, wherein the antibody comprises the VL of SEQ ID NO: 97.

39. The antibody of claim 32, which is a full length IgG antibody.

40. The antibody of claim 39, wherein the IgG antibody is IgG1, IgG2, IgG3 or IgG4.

41. The antibody of claim 40 wherein the IgG antibody is IgG1.

42. The antibody of claim 32, which comprises a variant Fc region amino acid sequence of SEQ ID NO: 229-380, or 381.

43. A pharmaceutical composition comprising the antibody of claim 32 and a pharmaceutically acceptable carrier.

* * * * *